United States Patent 12,508,308 (INFLUENZA mRNA VACCINES) - sequence listing, part 22

SEQ ID NO: 80980 - RNA, 1413 nt, Artificial Sequence
  derived and/or modified sequence opt1 from neuraminidase__InfluenzaA__ADN89581
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaagaccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacggcgacaccgccaacuggagcuggcccgacggcgccgagcugcccuucaccaucgacaaguga

SEQ ID NO: 80981 - RNA, 1413 nt, Artificial Sequence; identical to SEQ ID NO: 79938
  derived and/or modified sequence opt1 from neuraminidase__InfluenzaA__ADN89592

SEQ ID NO: 80982 - RNA, 1413 nt, Artificial Sequence; identical to SEQ ID NO: 79938
  derived and/or modified sequence opt1 from neuraminidase__InfluenzaA__ADN89603

SEQ ID NO: 80983 - RNA, 1413 nt, Artificial Sequence; identical to SEQ ID NO: 80948
  derived and/or modified sequence opt1 from neuraminidase__InfluenzaA__ADN89614

SEQ ID NO: 80984 - RNA, 1413 nt, Artificial Sequence; identical to SEQ ID NO: 80967
  derived and/or modified sequence opt1 from neuraminidase__InfluenzaA__ADN89625

SEQ ID NO: 80985 - RNA, 1413 nt, Artificial Sequence; identical to SEQ ID NO: 78469
  derived and/or modified sequence opt1 from neuraminidase__InfluenzaA__ADN89636

SEQ ID NO: 80986 - RNA, 1413 nt, Artificial Sequence; identical to SEQ ID NO: 78469
  derived and/or modified sequence opt1 from neuraminidase__InfluenzaA__ADN89647

SEQ ID NO: 80987 - RNA, 1413 nt, Artificial Sequence; identical to SEQ ID NO: 78469
  derived and/or modified sequence opt1 from neuraminidase__InfluenzaA__ADN89658

SEQ ID NO: 80988 - RNA, 1413 nt, Artificial Sequence; identical to SEQ ID NO: 79938
  derived and/or modified sequence opt1 from neuraminidase__InfluenzaA__ADN89669

SEQ ID NO: 80989 - RNA, 1413 nt, Artificial Sequence; identical to SEQ ID NO: 78469
  derived and/or modified sequence opt1 from neuraminidase__InfluenzaA__ADN89680

SEQ ID NO: 80990 - RNA, 1413 nt, Artificial Sequence; identical to SEQ ID NO: 78469
  derived and/or modified sequence opt1 from neuraminidase__InfluenzaA__ADN89691

SEQ ID NO: 80991 - RNA, 1413 nt, Artificial Sequence; identical to SEQ ID NO: 80967
  derived and/or modified sequence opt1 from neuraminidase__InfluenzaA__ADN89702

SEQ ID NO: 80992 - RNA, 1413 nt, Artificial Sequence; identical to SEQ ID NO: 78469
  derived and/or modified sequence opt1 from neuraminidase__InfluenzaA__ADN89713

SEQ ID NO: 80993 - RNA, 1413 nt, Artificial Sequence; identical to SEQ ID NO: 78469
  derived and/or modified sequence opt1 from neuraminidase__InfluenzaA__ADN89724

SEQ ID NO: 80994 - RNA, 1413 nt, Artificial Sequence; identical to SEQ ID NO: 78469
  derived and/or modified sequence opt1 from neuraminidase__InfluenzaA__ADN89735

SEQ ID NO: 80995 - RNA, 1413 nt, Artificial Sequence; identical to SEQ ID NO: 78469
  derived and/or modified sequence opt1 from neuraminidase__InfluenzaA__ADN89746

SEQ ID NO: 80996 - RNA, 1413 nt, Artificial Sequence; identical to SEQ ID NO: 78469
  derived and/or modified sequence opt1 from neuraminidase__InfluenzaA__ADN89757

SEQ ID NO: 80997 - RNA, 1413 nt, Artificial Sequence; identical to SEQ ID NO: 78469
  derived and/or modified sequence opt1 from neuraminidase__InfluenzaA__ADN89768

SEQ ID NO: 80998 - RNA, 1413 nt, Artificial Sequence; identical to SEQ ID NO: 80944
  derived and/or modified sequence opt1 from neuraminidase__InfluenzaA__ADN89779

SEQ ID NO: 80999 - RNA, 1413 nt, Artificial Sequence; identical to SEQ ID NO: 78469
  derived and/or modified sequence opt1 from neuraminidase__InfluenzaA__ADN89790

SEQ ID NO: 81000 - RNA, 1413 nt, Artificial Sequence
  derived and/or modified sequence opt1 from neuraminidase__InfluenzaA__ADN89801
augaaccccaaccagaagaucaucaccaucggcagcaucuccaucgccaucgggaccaucagccugaugcuccagaucggcaacaucaucuccaucugggccagccacuccauccagacggggagccagaacaacaccggcaucugcaaccagcgcaucaucaccuacaagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 81001 - RNA, 1413 nt, Artificial Sequence
  derived and/or modified sequence opt1 from neuraminidase__InfluenzaA__ADN89823
augaaccccaaccagaagaucaucaccaucggcagcaucuccaucgccaucgggaucaucagccugaugcuccagaucggcuccaucaucagcaucugggccucccacagcauccacaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 81002 - RNA, 1413 nt, Artificial Sequence; identical to SEQ ID NO: 79938
  derived and/or modified sequence opt1 from neuraminidase__InfluenzaA__ADN89834

SEQ ID NO: 81003 - RNA, 1413 nt, Artificial Sequence; identical to SEQ ID NO: 80940
  derived and/or modified sequence opt1 from neuraminidase__InfluenzaA__ADN89845

SEQ ID NO: 81004 - RNA, 1413 nt, Artificial Sequence; identical to SEQ ID NO: 78469
  derived and/or modified sequence opt1 from neuraminidase__InfluenzaA__ADN89856

SEQ ID NO: 81005 - RNA, 1410 nt, Artificial Sequence; identical to SEQ ID NO: 80418
  derived and/or modified sequence opt1 from neuraminidase__InfluenzaA__ADN89867

SEQ ID NO: 81006 - RNA, 1410 nt, Artificial Sequence; identical to SEQ ID NO: 80418
  derived and/or modified sequence opt1 from neuraminidase__InfluenzaA__ADN89878

SEQ ID NO: 81007 - RNA, 1410 nt, Artificial Sequence; identical to SEQ ID NO: 80418
  derived and/or modified sequence opt1 from neuraminidase__InfluenzaA__ADN89889

SEQ ID NO: 81008 - RNA, 1410 nt, Artificial Sequence; identical to SEQ ID NO: 80418
  derived and/or modified sequence opt1 from neuraminidase__InfluenzaA__ADN89900

SEQ ID NO: 81009 - RNA, 1410 nt, Artificial Sequence; identical to SEQ ID NO: 80418
  derived and/or modified sequence opt1 from neuraminidase__InfluenzaA__ADN89911

SEQ ID NO: 81010 - RNA, 1410 nt, Artificial Sequence
  derived and/or modified sequence opt1 from neuraminidase__InfluenzaA__ADN89922
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaacaucaugcccaucuga

SEQ ID NO: 81011 - RNA, 1410 nt, Artificial Sequence; identical to SEQ ID NO: 80418
  derived and/or modified sequence opt1 from neuraminidase__InfluenzaA__ADN89933

SEQ ID NO: 81012 - RNA, 1410 nt, Artificial Sequence; identical to SEQ ID NO: 80418
  derived and/or modified sequence opt1 from neuraminidase__InfluenzaA__ADN89955

SEQ ID NO: 81013 - RNA, 1410 nt, Artificial Sequence; identical to SEQ ID NO: 80418
  derived and/or modified sequence opt1 from neuraminidase__InfluenzaA__ADN89966

SEQ ID NO: 81014 - RNA, 1410 nt, Artificial Sequence; identical to SEQ ID NO: 80418
  derived and/or modified sequence opt1 from neuraminidase__InfluenzaA__ADN89977

SEQ ID NO: 81015 - RNA, 1410 nt, Artificial Sequence; identical to SEQ ID NO: 80418
  derived and/or modified sequence opt1 from neuraminidase__InfluenzaA__ADN89988

SEQ ID NO: 81016 - RNA, 1410 nt, Artificial Sequence; identical to SEQ ID NO: 80418
  derived and/or modified sequence opt1 from neuraminidase__InfluenzaA__ADN89999

SEQ ID NO: 81017 - RNA, 1410 nt, Artificial Sequence; identical to SEQ ID NO: 80418
  derived and/or modified sequence opt1 from neuraminidase__InfluenzaA__ADN90010

SEQ ID NO: 81018 - RNA, 1410 nt, Artificial Sequence; identical to SEQ ID NO: 80418
  derived and/or modified sequence opt1 from neuraminidase__InfluenzaA__ADN90021

SEQ ID NO: 81019 - RNA, 1410 nt, Artificial Sequence; identical to SEQ ID NO: 80418
  derived and/or modified sequence opt1 from neuraminidase__InfluenzaA__ADN90032

SEQ ID NO: 81020 - RNA, 1410 nt, Artificial Sequence; identical to SEQ ID NO: 80418
  derived and/or modified sequence opt1 from neuraminidase__InfluenzaA__ADN90043

SEQ ID NO: 81021 - RNA, 1410 nt, Artificial Sequence; identical to SEQ ID NO: 80418
  derived and/or modified sequence opt1 from neuraminidase__InfluenzaA__ADN90054

SEQ ID NO: 81022 - RNA, 1410 nt, Artificial Sequence; identical to SEQ ID NO: 80418
  derived and/or modified sequence opt1 from neuraminidase__InfluenzaA__ADN90065

SEQ ID NO: 81023 - RNA, 1410 nt, Artificial Sequence; identical to SEQ ID NO: 80418
  derived and/or modified sequence opt1 from neuraminidase__InfluenzaA__ADN90076

SEQ ID NO: 81024 - RNA, 1410 nt, Artificial Sequence; identical to SEQ ID NO: 80418
  derived and/or modified sequence opt1 from neuraminidase__InfluenzaA__ADN90087

SEQ ID NO: 81025 - RNA, 1410 nt, Artificial Sequence; identical to SEQ ID NO: 80418
  derived and/or modified sequence opt1 from neuraminidase__InfluenzaA__ADN90098

SEQ ID NO: 81026 - RNA, 1410 nt, Artificial Sequence; identical to SEQ ID NO: 80418
  derived and/or modified sequence opt1 from neuraminidase__InfluenzaA__ADN90109

SEQ ID NO: 81027 - RNA, 1410 nt, Artificial Sequence; identical to SEQ ID NO: 80418
  derived and/or modified sequence opt1 from neuraminidase__InfluenzaA__ADN90120

SEQ ID NO: 81028 - RNA, 1410 nt, Artificial Sequence; identical to SEQ ID NO: 80418
  derived and/or modified sequence opt1 from neuraminidase__InfluenzaA__ADN90131

SEQ ID NO: 81029 - RNA, 1410 nt, Artificial Sequence; identical to SEQ ID NO: 80418
  derived and/or modified sequence opt1 from neuraminidase__InfluenzaA__ADN90142

SEQ ID NO: 81030 - RNA, 1410 nt, Artificial Sequence; identical to SEQ ID NO: 80418
  derived and/or modified sequence opt1 from neuraminidase__InfluenzaA__ADN90153

SEQ ID NO: 81031 - RNA, 1410 nt, Artificial Sequence; identical to SEQ ID NO: 80418
  derived and/or modified sequence opt1 from neuraminidase__InfluenzaA__ADN90164

SEQ ID NO: 81032 - RNA, 1410 nt, Artificial Sequence; identical to SEQ ID NO: 80418
  derived and/or modified sequence opt1 from neuraminidase__InfluenzaA__ADN90186

SEQ ID NO: 81033 - RNA, 1410 nt, Artificial Sequence; identical to SEQ ID NO: 80418
  derived and/or modified sequence opt1 from neuraminidase__InfluenzaA__ADN90197

SEQ ID NO: 81034 - RNA, 1410 nt, Artificial Sequence
  derived and/or modified sequence opt1 from neuraminidase__InfluenzaA__ADN90208
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccgguccaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcacguccggcaccuacgggaccggcagcuggccggacggggccgaccugaaccucaugcccaucuga

SEQ ID NO: 81035 - RNA, 1410 nt, Artificial Sequence; identical to SEQ ID NO: 80418
  derived and/or modified sequence opt1 from neuraminidase__InfluenzaA__ADN90219

SEQ ID NO: 81036 - RNA, 1410 nt, Artificial Sequence
  derived and/or modified sequence opt1 from neuraminidase__InfluenzaA__ADN92469
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcgagaaggccgacaccaagauccucuucaucgaggagggcaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucagcgagaagucccggcugggcuacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 81037 - RNA, 1410 nt, Artificial Sequence; identical to SEQ ID NO: 80263
  derived and/or modified sequence opt1 from neuraminidase__InfluenzaA__ADN92480

SEQ ID NO: 81038 - RNA, 1410 nt, Artificial Sequence; identical to SEQ ID NO: 80263
  derived and/or modified sequence opt1 from neuraminidase__InfluenzaA__ADN92491

SEQ ID NO: 81039 - RNA, 1410 nt, Artificial Sequence
  derived and/or modified sequence opt1 from neuraminidase__InfluenzaA__ADN92502
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggaacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaacgaggugcuguggaccuccaacagcaucgucguguucugcggcaccuccgggaccuacggcacggggagcuggccggacggcgccgacaucaaccugaugcccaucuga

SEQ ID NO: 81040 - RNA, 1410 nt, Artificial Sequence; identical to SEQ ID NO: 77746
  derived and/or modified sequence opt1 from neuraminidase__InfluenzaA__ADN92512

SEQ ID NO: 81041 - RNA, 1410 nt, Artificial Sequence; identical to SEQ ID NO: 77746
  derived and/or modified sequence opt1 from neuraminidase__InfluenzaA__ADN92522

SEQ ID NO: 81042 - RNA, 1410 nt, Artificial Sequence; identical to SEQ ID NO: 77746
  derived and/or modified sequence opt1 from neuraminidase__InfluenzaA__ADN92532

SEQ ID NO: 81043 - RNA, 1410 nt, Artificial Sequence; identical to SEQ ID NO: 77746
  derived and/or modified sequence opt1 from neuraminidase__InfluenzaA__ADN92542

SEQ ID NO: 81044 - RNA, 1410 nt, Artificial Sequence; identical to SEQ ID NO: 77746
  derived and/or modified sequence opt1 from neuraminidase__InfluenzaA__ADN92552

SEQ ID NO: 81045 - RNA, 1410 nt, Artificial Sequence; identical to SEQ ID NO: 77746
  derived and/or modified sequence opt1 from neuraminidase__InfluenzaA__ADO00733

SEQ ID NO: 81046 - RNA, 1410 nt, Artificial Sequence
  derived and/or modified sequence opt1 from neuraminidase__InfluenzaA__ADO00743
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcauccgccaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgcggagcugccguucacgaucgacaaguga

SEQ ID NO: 81047 - RNA, 1410 nt, Artificial Sequence; identical to SEQ ID NO: 78923
  derived and/or modified sequence opt1 from neuraminidase__InfluenzaA__ADO00753

SEQ ID NO: 81048 - RNA, 1410 nt, Artificial Sequence; identical to SEQ ID NO: 77746
  derived and/or modified sequence opt1 from neuraminidase__InfluenzaA__ADO12146

SEQ ID NO: 81049 - RNA, 1410 nt, Artificial Sequence; identical to SEQ ID NO: 77746
  derived and/or modified sequence opt1 from neuraminidase__InfluenzaA__ADO12156

SEQ ID NO: 81050 - RNA, 1410 nt, Artificial Sequence; identical to SEQ ID NO: 77746
  derived and/or modified sequence opt1 from neuraminidase__InfluenzaA__ADO12166

SEQ ID NO: 81051 - RNA, 1410 nt, Artificial Sequence; identical to SEQ ID NO: 77746
  derived and/or modified sequence opt1 from neuraminidase__InfluenzaA__ADO12176

SEQ ID NO: 81052 - RNA, 1410 nt, Artificial Sequence; identical to SEQ ID NO: 77746
  derived and/or modified sequence opt1 from neuraminidase__InfluenzaA__ADO12186

SEQ ID NO: 81053 - RNA, 1410 nt, Artificial Sequence; identical to SEQ ID NO: 77746
  derived and/or modified sequence opt1 from neuraminidase__InfluenzaA__ADO12196

SEQ ID NO: 81054 - RNA, 1410 nt, Artificial Sequence; identical to SEQ ID NO: 77746
  derived and/or modified sequence opt1 from neuraminidase__InfluenzaA__ADO12206

SEQ ID NO: 81055 - RNA, 1410 nt, Artificial Sequence; identical to SEQ ID NO: 77746
  derived and/or modified sequence opt1 from neuraminidase__InfluenzaA__ADO12216

SEQ ID NO: 81056 - RNA, 1410 nt, Artificial Sequence; identical to SEQ ID NO: 77746
  derived and/or modified sequence opt1 from neuraminidase__InfluenzaA__ADO12226

SEQ ID NO: 81057 - RNA, 1410 nt, Artificial Sequence; identical to SEQ ID NO: 77746
  derived and/or modified sequence opt1 from neuraminidase__InfluenzaA__ADO12246

SEQ ID NO: 81058 - RNA, 1410 nt, Artificial Sequence; identical to SEQ ID NO: 77746
  derived and/or modified sequence opt1 from neuraminidase__InfluenzaA__ADO12266

SEQ ID NO: 81059 - RNA, 1410 nt, Artificial Sequence
  derived and/or modified sequence opt1 from neuraminidase__InfluenzaA__ADO12276
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagagcggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 81060 - RNA, 1410 nt, Artificial Sequence; identical to SEQ ID NO: 77746
  derived and/or modified sequence opt1 from neuraminidase__InfluenzaA__ADO12286

SEQ ID NO: 81061 - RNA, 1410 nt, Artificial Sequence; identical to SEQ ID NO: 77746
  derived and/or modified sequence opt1 from neuraminidase__InfluenzaA__ADO12296

SEQ ID NO: 81062 - RNA, 1410 nt, Artificial Sequence; identical to SEQ ID NO: 77746
  derived and/or modified sequence opt1 from neuraminidase__InfluenzaA__ADO12306

SEQ ID NO: 81063 - RNA, 1410 nt, Artificial Sequence
  derived and/or modified sequence opt1 from neuraminidase__InfluenzaA__ADO12316
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcgacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81064 - RNA, 1410 nt, Artificial Sequence; identical to SEQ ID NO: 77746
  derived and/or modified sequence opt1 from neuraminidase__InfluenzaA__ADO12326

SEQ ID NO: 81065 - RNA, 1410 nt, Artificial Sequence; identical to SEQ ID NO: 77746
  derived and/or modified sequence opt1 from neuraminidase__InfluenzaA__ADO12336

SEQ ID NO: 81066 - RNA, 1410 nt, Artificial Sequence; identical to SEQ ID NO: 77746
  derived and/or modified sequence opt1 from neuraminidase__InfluenzaA__ADO12346

SEQ ID NO: 81067 - RNA, 1410 nt, Artificial Sequence; identical to SEQ ID NO: 77746
  derived and/or modified sequence opt1 from neuraminidase__InfluenzaA__ADO12356

SEQ ID NO: 81068 - RNA, 1410 nt, Artificial Sequence; identical to SEQ ID NO: 77746
  derived and/or modified sequence opt1 from neuraminidase__InfluenzaA__ADO12366

SEQ ID NO: 81069 - RNA, 1410 nt, Artificial Sequence; identical to SEQ ID NO: 77746
  derived and/or modified sequence opt1 from neuraminidase__InfluenzaA__ADO12376

SEQ ID NO: 81070 - RNA, 1410 nt, Artificial Sequence; identical to SEQ ID NO: 77746
  derived and/or modified sequence opt1 from neuraminidase__InfluenzaA__ADO12386

SEQ ID NO: 81071 - RNA, 1410 nt, Artificial Sequence; identical to SEQ ID NO: 77746
  derived and/or modified sequence opt1 from neuraminidase__InfluenzaA__ADO12396

SEQ ID NO: 81072 - RNA, 1410 nt, Artificial Sequence; identical to SEQ ID NO: 77746
  derived and/or modified sequence opt1 from neuraminidase__InfluenzaA__ADO12406

SEQ ID NO: 81073 - RNA, 1410 nt, Artificial Sequence; identical to SEQ ID NO: 78513
  derived and/or modified sequence opt1 from neuraminidase__InfluenzaA__ADO12416

SEQ ID NO: 81074 - RNA, 1410 nt, Artificial Sequence; identical to SEQ ID NO: 77746
  derived and/or modified sequence opt1 from neuraminidase__InfluenzaA__ADO12426

SEQ ID NO: 81075 - RNA, 1410 nt, Artificial Sequence; identical to SEQ ID NO: 77746
  derived and/or modified sequence opt1 from neuraminidase__InfluenzaA__ADO12436

SEQ ID NO: 81076 - RNA, 1410 nt, Artificial Sequence; identical to SEQ ID NO: 77746
  derived and/or modified sequence opt1 from neuraminidase__InfluenzaA__ADO12446

SEQ ID NO: 81077 - RNA, 1410 nt, Artificial Sequence; identical to SEQ ID NO: 77746
  derived and/or modified sequence opt1 from neuraminidase__InfluenzaA__ADO12456

SEQ ID NO: 81078 - RNA, 1410 nt, Artificial Sequence; identical to SEQ ID NO: 77746
  derived and/or modified sequence opt1 from neuraminidase__InfluenzaA__ADO12466

SEQ ID NO: 81079 - RNA, 1410 nt, Artificial Sequence; identical to SEQ ID NO: 77746
  derived and/or modified sequence opt1 from neuraminidase__InfluenzaA__ADO12476

SEQ ID NO: 81080 - RNA, 1410 nt, Artificial Sequence; identical to SEQ ID NO: 77746
  derived and/or modified sequence opt1 from neuraminidase__InfluenzaA__ADO12486

SEQ ID NO: 81081 - RNA, 1410 nt, Artificial Sequence; identical to SEQ ID NO: 77746
  derived and/or modified sequence opt1 from neuraminidase__InfluenzaA__ADO12496

SEQ ID NO: 81082 - RNA, 1410 nt, Artificial Sequence; identical to SEQ ID NO: 77746
  derived and/or modified sequence opt1 from neuraminidase__InfluenzaA__ADO12506

SEQ ID NO: 81083 - RNA, 1410 nt, Artificial Sequence; identical to SEQ ID NO: 77746
  derived and/or modified sequence opt1 from neuraminidase__InfluenzaA__ADO12516

SEQ ID NO: 81084 - RNA, 1410 nt, Artificial Sequence; identical to SEQ ID NO: 77746
  derived and/or modified sequence opt1 from neuraminidase__InfluenzaA__ADO12526

SEQ ID NO: 81085 - RNA, 1410 nt, Artificial Sequence; identical to SEQ ID NO: 77746
  derived and/or modified sequence opt1 from neuraminidase__InfluenzaA__ADO12536

SEQ ID NO: 81086 - RNA, 1410 nt, Artificial Sequence; identical to SEQ ID NO: 77746
  derived and/or modified sequence opt1 from neuraminidase__InfluenzaA__ADO12546

SEQ ID NO: 81087 - RNA, 1410 nt, Artificial Sequence; identical to SEQ ID NO: 77746
  derived and/or modified sequence opt1 from neuraminidase__InfluenzaA__ADO12556

SEQ ID NO: 81088 - RNA, 1410 nt, Artificial Sequence; identical to SEQ ID NO: 77746
  derived and/or modified sequence opt1 from neuraminidase__InfluenzaA__ADO12566

SEQ ID NO: 81089 - RNA, 1410 nt, Artificial Sequence; identical to SEQ ID NO: 77746
  derived and/or modified sequence opt1 from neuraminidase__InfluenzaA__ADO12576

SEQ ID NO: 81090 - RNA, 1410 nt, Artificial Sequence
  derived and/or modified sequence opt1 from neuraminidase__InfluenzaA__ADO12586
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacagcggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81091 - RNA, 1410 nt, Artificial Sequence; identical to SEQ ID NO: 81090
  derived and/or modified sequence opt1 from neuraminidase__InfluenzaA__ADO12596

SEQ ID NO: 81092 - RNA, 1410 nt, Artificial Sequence; identical to SEQ ID NO: 77746
  derived and/or modified sequence opt1 from neuraminidase__InfluenzaA__ADO12606

SEQ ID NO: 81093 - RNA, 1410 nt, Artificial Sequence; identical to SEQ ID NO: 77746
  derived and/or modified sequence opt1 from neuraminidase__InfluenzaA__ADO12616

SEQ ID NO: 81094 - RNA, 1410 nt, Artificial Sequence; identical to SEQ ID NO: 77746
  derived and/or modified sequence opt1 from neuraminidase__InfluenzaA__ADO12626

SEQ ID NO: 81095 - RNA, 1410 nt, Artificial Sequence; identical to SEQ ID NO: 77746
  derived and/or modified sequence opt1 from neuraminidase__InfluenzaA__ADO14355

SEQ ID NO: 81096 - RNA, 1401 nt, Artificial Sequence
  derived and/or modified sequence opt1 from neuraminidase__InfluenzaA__ADO21028
augaaccccaaccagaagaucaucgccaucggcagcgugucccugaccaucgccaccaucugcuuccucaugcagaucgcgauccuggccacgaccaugacccugcacuucaagcagaacgagugcagcaacccguccaacaaccaggucgugcccugcgagcccaccaucaucgagcgcaacaucgugcaccucaacagcacgaccaucgagaaggagaucugccccaaggucgccgaguacaagaacugguccaagccgcagugccagaucaccgggagcgcccccuucuccaagggcaacagcauccggcuguccgccgggggcgacaucugggugacccgcgagcccuacgugagcugcucccuggggaagugcuaccaguucgcgcucggccagggcacgacccugaagaacaagcacagcaacgggaccacccacgaccgggucccccaccgcacgcugcucauguccgagcugggcgugccguuccaccuggggaccaagcaggucugcaucgccuggagcuccagcuccugccacgacggcaaggccuggcuccacgugugcgugaccggggacgacaagaacgccaccgcgagcaucaucuacgacggcaugcugguggacuccaucggcagcuggagcaagaacauccugcggacgcaggaguccgagugcgucugcaucaacgggaccugcaccguggugaugaccgacggcagcgccuccgggaaggccgacacgcgcauccucuucauccgggagggcaagaucguccacaucagcccccuguccggcagcgcccagcacguggaggagugcuccugcuacccccgcuaccccgaggugcggugcgucugccgcgacaacuggaaggggagcaaccggccggugcuguacaucaacauggccgacuacuccaucgagagcuccuacgugugcagcggccucgucggggacacgccccgcaacgacgacuccuacagcuccagcaacugccgggaccccaacaacgagcgcggcgcgcccggggugaagggcugggccuucgacaacggcaacgacaucuggauggggcggaccaucaaggaggacucccgcagcggcuacgagaccuuccggguggucgggggcuggaccaccgccaacuccaagagccagaucaaccgccaggugaucgucgacagcgacaacugguccggguacagcggcaucuucuccguggagggcaagaacugcaucaaccggugcuucuacguggagcugauccgcgggcggccgcaggagacccgcgucugguggaccagcaacuccaucaucguguucugcggcacgagcgggaccuacggcaccggguccuggcccgacggcgccaacaucaacuucaugcccaucuga

SEQ ID NO: 81097 - RNA, 1401 nt, Artificial Sequence
  derived and/or modified sequence opt1 from neuraminidase__InfluenzaA__ADO21039
augaaccccaaccagaagaucaucgccaucggcagcgugucccugaccaucgccaccaucugcuuccucaugcagaucgcgauccuggccacgaccaugacccugcacuucaagcagaacgagugcagcaacccguccaacaaccaggucgugcccugcgagcccaccaucaucgagcgcaacaucgugcaccucaacagcacgaccaucgagaaggagaucugccccaaggucgccgaguacaagaacugguccaagccgcagugccagaucaccgggagcgcccccuucuccaagggcaacagcauccggcuguccgccgggggcgacaucugggugacccgcgagcccuacgugagcugcucccuggggaagugcuaccaguucgcgcucggccagggcacgacccugaagaacaagcacagcaacgggaccacccacgaccgggacccccaccgcacgcugcucauguccgagcugggcgucccguuccaccuggggaccaagcaggucugcaucgccuggagcuccagcuccugccacgacggcaaggccuggcuccacgugugcgugaccggggacgacaagaacgccaccgcgagcaucaucuacgacggcaugcugguggacuccaucggcagcuggagcaagaacauccugcggacgcaggaguccgagugcgugugcaucaacgggaccugcaccgucgugaugaccgacggcagcgccuccgggaaggccgacacgcgcauccucuucauccgggagggcaagaucgugcacaucagcccccuguccggcagcgcccagcacgucgaggagugcuccugcuacccccgcuaccccgaggugcggugcgugugccgcgacaacuggaaggggagcaaccggccgguccuguacaucaacauggccgacuacaccaucgaguccagcuacgugugcuccggccucgugggggacacgccccgcaacgacgacagcuacuccagcuccaacugccgggaccccaacaacgagcgcggcgcgcccggggucaagggcugggccuucgacaacggcaacgacaucuggauggggcggaccaucaaggaggacagccgcuccggcuacgagaccuuccggguggucgggggcuggaccaccgccaacagcaagucccagaucaaccgccaggugaucguggacagcgacaacuggagcggguacuccggcaucuucagcgucgagggcaagaacugcaucaaccggugcuucuacguggagcugauccgcgggcggccgcaggagacccgcgugugguggacguccaacagcaucaucgucuucugcggcaccuccgggaccuacggcaccgggagcuggcccgacggcgccaacaucaacuucaugcccaucuga

SEQ ID NO: 81098 - RNA, 1401 nt, Artificial Sequence
  derived and/or modified sequence opt1 from neuraminidase__InfluenzaA__ADO21050
augaaccccaaccagaagaucaucgccaucggcagcgugucccugaccaucgccaccaucugcuuccucaugcagaucgcgauccuggccacgaccaugacccugcacuucaagcagaacgagugcagcaacccguccaacaaccaggucgugcccugcgagcccaccaucaucgagcgcaacaucgugcaccucaacagcacgaccaucgagaaggagaucugccccaaggucgccgaguacaagaacugguccaagccgcagugccagaucaccgggagcgcccccuucuccaagggcaacagcauccggcuguccgccgggggcgacaucugggugacccgcgagcccuacgugagcugcucccuggggaagugcuaccaguucgcgcucggccagggcacgacccugaagaacaagcacagcaacgggaccacccacgaccggggcccccaccgcacgcugcucauguccgagcugggggucccguuccaccugggcaccaagcaggucugcaucgccuggagcuccagcuccugccacgacgggaaggccuggcuccacgugugcgugaccggcgacgacaagaacgccaccgcgagcaucaucuacgacggcaugcugguggacuccaucgggagcuggagcaagaacauccugcggacgcaggaguccgagugcgugugcaucaacgggaccugcaccgucgugaugaccgacggcagcgccuccggcaaggccgacacgcgcauccucuucauccgggagggcaagaucgugcacaucagcccccuguccgggagcgcccagcacgucgaggagugcuccugcuacccccgcuaccccgaggugcggugcgugugccgcgacaacuggaagggcagcaaccggccgguccuguacaucaacauggccgacuacuccaucgagagcuccuacgugugcagcgggcucgugggcgacacgccccgcaacgacgacuccuacagcuccagcaacugccgggaccccaacaacgaguccggggcgcccggcgucaagggcugggccuucgacaacgggaacgacaucuggaugggccgcaccaucaaggaggacagccgguccggguacgagaccuuccgcguggugggcggguggaccaccgccaacagcaagagccagaucaaccggcaggucaucguggacuccgacaacuggagcggcuacuccggcaucuucagcgucgaggggaagaacugcaucaaccgcugcuucuacguggagcugauccggggccgcccgcaggagacccgggugugguggaccuccaacagcaucaucgucuucugcgggacguccggcaccuacgggaccggcagcuggcccgacggcgccaacaucaacuucaugcccaucuga

SEQ ID NO: 81099 - RNA, 1410 nt, Artificial Sequence
  derived and/or modified sequence opt1 from neuraminidase__InfluenzaA__ADO25095
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81100 - RNA, 1410 nt, Artificial Sequence
  derived and/or modified sequence opt1 from neuraminidase__InfluenzaA__ADO25105
augaaccccaaccagaagaucaucaccaucggcagcgugugcaugaccaucgggauggccaaccugauccuccagaucggcaacaucaucuccaucuggaucagccacuccauccagcuggggaaccagaaccagaucggcacgugcaaccagagcgucaucaccuacgagaccaacaccugggugaaccagacguacgugaacaucuccaacaccaacuucgccgcggggcagagcgucguguccgugaagcuggccggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcacgaucaaggaccggucccccuaccgcacccugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacacgaucaagagcuggcgcaacaacauccugcggacccaggaguccgagugcgcgugcgugaacggcagcugcuucaccgugaugaccgacggcccguccgaccgccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacaccaucuggaccagcggguccagcaucuccuucugcggcgugaacagcgacacggucgggugguccuggcccgacggcgccgagcugccguucaccaucgacaaguga

SEQ ID NO: 81101 - RNA, 1410 nt, Artificial Sequence; identical to SEQ ID NO: 79527
  derived and/or modified sequence opt1 from neuraminidase__InfluenzaA__ADO25115

SEQ ID NO: 81102 - RNA, 1410 nt, Artificial Sequence; identical to SEQ ID NO: 79527
  derived and/or modified sequence opt1 from neuraminidase__InfluenzaA__ADO25125

SEQ ID NO: 81103 - RNA, 1410 nt, Artificial Sequence
  derived and/or modified sequence opt1 from neuraminidase__InfluenzaA__ADO25135
augaaccccaaccagaagaucaucaccaucggcagcgugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81104 - RNA, 1410 nt, Artificial Sequence; identical to SEQ ID NO: 79097
  derived and/or modified sequence opt1 from neuraminidase__InfluenzaA__ADO25145

SEQ ID NO: 81105 - RNA, 1410 nt, Artificial Sequence; identical to SEQ ID NO: 77746
  derived and/or modified sequence opt1 from neuraminidase__InfluenzaA__ADO25155

SEQ ID NO: 81106 - RNA, 1410 nt, Artificial Sequence; identical to SEQ ID NO: 77746
  derived and/or modified sequence opt1 from neuraminidase__InfluenzaA__ADO25165

SEQ ID NO: 81107 - RNA, 1410 nt, Artificial Sequence; identical to SEQ ID NO: 77746
  derived and/or modified sequence opt1 from neuraminidase__InfluenzaA__ADO25175

SEQ ID NO: 81108 - RNA, 1410 nt, Artificial Sequence
  derived and/or modified sequence opt1 from neuraminidase__InfluenzaA__ADO25185
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaugagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81109 - RNA, 1410 nt, Artificial Sequence; identical to SEQ ID NO: 80175
  derived and/or modified sequence opt1 from neuraminidase__InfluenzaA__ADO25195

SEQ ID NO: 81110 - RNA, 1410 nt, Artificial Sequence; identical to SEQ ID NO: 78883
  derived and/or modified sequence opt1 from neuraminidase__InfluenzaA__ADO25205

SEQ ID NO: 81111 - RNA, 1410 nt, Artificial Sequence; identical to SEQ ID NO: 79097
  derived and/or modified sequence opt1 from neuraminidase__InfluenzaA__ADO25215

SEQ ID NO: 81112 - RNA, 1410 nt, Artificial Sequence; identical to SEQ ID NO: 77746
  derived and/or modified sequence opt1 from neuraminidase__InfluenzaA__ADO25225

SEQ ID NO: 81113 - RNA, 1410 nt, Artificial Sequence; identical to SEQ ID NO: 79097
  derived and/or modified sequence opt1 from neuraminidase__InfluenzaA__ADO25235

SEQ ID NO: 81114 - RNA, 1410 nt, Artificial Sequence; identical to SEQ ID NO: 77746
  derived and/or modified sequence opt1 from neuraminidase__InfluenzaA__ADO25245

SEQ ID NO: 81115 - RNA, 1410 nt, Artificial Sequence; identical to SEQ ID NO: 77746
  derived and/or modified sequence opt1 from neuraminidase__InfluenzaA__ADO25255

SEQ ID NO: 81116 - RNA, 1410 nt, Artificial Sequence; identical to SEQ ID NO: 79527
  derived and/or modified sequence opt1 from neuraminidase__InfluenzaA__ADO25265

SEQ ID NO: 81117 - RNA, 1410 nt, Artificial Sequence; identical to SEQ ID NO: 79338
  derived and/or modified sequence opt1 from neuraminidase__InfluenzaA__ADO25275

SEQ ID NO: 81118 - RNA, 1410 nt, Artificial Sequence; identical to SEQ ID NO: 79097
  derived and/or modified sequence opt1 from neuraminidase__InfluenzaA__ADO25285

SEQ ID NO: 81119 - RNA, 1413 nt, Artificial Sequence
  derived and/or modified sequence opt1 from neuraminidase__InfluenzaA__ADO27623
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacguggcggccggggaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccguggacggcgccaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 81120 - RNA, 1410 nt, Artificial Sequence; identical to SEQ ID NO: 77746
  derived and/or modified sequence opt1 from neuraminidase__InfluenzaA__ADO30410

SEQ ID NO: 81121 - RNA, 1410 nt, Artificial Sequence; identical to SEQ ID NO: 79097
  derived and/or modified sequence opt1 from neuraminidase__InfluenzaA__ADO30420

SEQ ID NO: 81122 - RNA, 1410 nt, Artificial Sequence; identical to SEQ ID NO: 78454
  derived and/or modified sequence opt1 from neuraminidase__InfluenzaA__ADP95343

SEQ ID NO: 81123 - RNA, 1410 nt, Artificial Sequence; identical to SEQ ID NO: 77736
  derived and/or modified sequence opt1 from neuraminidase__InfluenzaA__ADP95353

SEQ ID NO: 81124 - RNA, 1410 nt, Artificial Sequence; identical to SEQ ID NO: 77736
  derived and/or modified sequence opt1 from neuraminidase__InfluenzaA__ADP95363

SEQ ID NO: 81125 - RNA, 1410 nt, Artificial Sequence; identical to SEQ ID NO: 77736
  derived and/or modified sequence opt1 from neuraminidase__InfluenzaA__ADP95373

SEQ ID NO: 81126 - RNA, 1410 nt, Artificial Sequence; identical to SEQ ID NO: 77736
  derived and/or modified sequence opt1 from neuraminidase__InfluenzaA__ADP95383

SEQ ID NO: 81127 - RNA, 1410 nt, Artificial Sequence; identical to SEQ ID NO: 77736
  derived and/or modified sequence opt1 from neuraminidase__InfluenzaA__ADP95393

SEQ ID NO: 81128 - RNA, 1410 nt, Artificial Sequence
  derived and/or modified sequence opt1 from neuraminidase__InfluenzaA__ADQ43774
augaaccccaaccagaagaucaucaccaucggcagcgggugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggucaaccagaccuacgugaacaucuccaacacgaacuucgccgcggggcagagcguggucuccgugaagcuggccggcaacagcucccucugcccggugagcggcugggccaucuacuccaaggacaacagcauccgcaucggguccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacggcccguccgacgggcaggccagcuacaagaucuuccgcaucgagaagggcaagaucgugaaguccgucgagaugaaggcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 81129 - RNA, 1410 nt, Artificial Sequence
  derived and/or modified sequence opt1 from neuraminidase__InfluenzaA__ADQ92578
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacgccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 81130 - RNA, 1410 nt, Artificial Sequence; identical to SEQ ID NO: 77607
  derived and/or modified sequence opt1 from neuraminidase__InfluenzaA__ADR32364

SEQ ID NO: 81131 - RNA, 1410 nt, Artificial Sequence
  derived and/or modified sequence opt1 from neuraminidase__InfluenzaA__ADT64478
augaaccccaaccagaagaucaucaccaucggcagcgugugcaugaccaucgggauggccaaccugauccuccagaucggcaacaucaucuccaucuggaucgggcacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucccgguucgagagcguggccuggagcgcguccgccugccacgacggcaucaacuggcucaccaucggcaucagcgggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 81132 - RNA, 1410 nt, Artificial Sequence
  derived and/or modified sequence opt1 from neuraminidase__InfluenzaA__ADT78889
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccagcuccugccacgacggcaaggcguggcugcacgucugcgugaccggggacgacaagaacgccaccgccagcuucaucuacgacggccggcucguggacuccaucgggagcuggucccagaacauccugcgcacgcaggagagcgagugcgucugcaucaacgggaccugcaccguggugaugaccgacggcuccgccagcgggcgggcggacacgcgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcucauccgcggccggcagcaggagacccgcgugugguggaccuccaacagcaucgucguguucugcggcaccuccgggacguacggcaccgggagcuggcccgacggcgccaacaucuccuucaugcccaucuga

SEQ ID NO: 81133 - RNA, 1410 nt, Artificial Sequence
  derived and/or modified sequence opt1 from neuraminidase__InfluenzaA__ADT78899
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucaugcgggagcccuacgugagcugcaaccccggcaagugcuaccaguucgcccuggggcagggcacgacccucgacaacaagcacuccaacggcaccauccacgaccgcaucccgcaccggacccugcugaugaacgagcucggggugcccuuccaccugggcacgaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacccaggagagcgagugcgugugcaucaacggcacgugcaccgucgugaugaccgacggguccgcgagcggccgggccgacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucuccaaggaccugcggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcucauccgcggccgcccccaggagacgcgggugugguggaccuccagcuccaucguggucuucugcgggaccagcggcaccuacgggacgggcuccuggcccgacggggccaacaucaacuucaugccgaucuga

SEQ ID NO: 81134 - RNA, 1410 nt, Artificial Sequence
  derived and/or modified sequence opt1 from neuraminidase__InfluenzaA__ADT78963
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcguggcguggagcuccagcuccugccacgacggcaaggccuggcugcacgugugcgucaccggggacgaccggaacgccaccgccagcuucaucuacgacggccgccucguggacuccaucgggagcuggucccagaacauccugcggacgcaggagagcgagugcgugugcaucaacgggaccugcaccgucgugaugaccgacggcuccgcgagcgggcgcgccgacacgcggauccuguucaucaaggagggcaagaucgugcacaucagcccccucuccgggagcgcccagcacgucgaggagugcuccugcuacccccgcuacccggacgugcggugcaucugccgcgacaacuggaagggcagcaaccggcccgugaucgacaucaacauggaggacuacuccaucgacagcuccuacgucugcagcggccuggugggggacacgccccgcaacgacgaccgguccagcaacuccaacugccgcgaccccaacaacgagcggggcaacccgggggugaagggcugggccuucgacaacgggaacgacgucuggaugggccgcaccaucagcaaggaccugcgguccggcuacgagaccuucaaggugaucgggggcuggagcacccccaacuccaagagccaggucaaccgccaggugaucguggacaacaacaacugguccggguacagcggcaucuucuccgucgagggcaagagcugcaucaaccgcugcuucuacguggagcucauccggggccgccagcaggagacccgggugugguggaccagcaacuccaucgucguguucugcggcaccagcgggacguacggcaccggguccuggcccgacggcgccaacaucaacuucaugcccaucuga

SEQ ID NO: 81135 - RNA, 1410 nt, Artificial Sequence
  derived and/or modified sequence opt1 from neuraminidase__InfluenzaA__ADT79001
augaaccccaaccagaagaucaucaccaucggcagcaucucccugaccaucgccacgaucugcuuccucaugcagaucgccauccuggugaccaccgucacccugcacuucaagcaguacgagugcgacagcccggcgaacaaccaggugaugcccugcgagcccaucaucaucgagcgcaacaucacggagaucguguaccucaccaacaccaccaucgagaaggagaucugccccaagcuggucgaguaccggaacugguccaagccgcagugcaagaucacgggguucgcccccuucagcaaggacaacuccauccgccugagcgccggcggggacaucugggugacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcguccccuuccaccuggggacccgccaggugugcaucgccugguccagcuccagcugccacgacggcaaggcguggcuccacgugugcgucaccggggacgacaagaacgccacggccuccuucaucuacgacggccggcugguggacagcaucggguccuggagccagaacauccugcgcacccaggaguccgagugcgugugcaucaacgggaccugcaccgucgugaugacggacggcagcgccuccggcaaggcggacacccggauccucuucaucgaggagggcaagaucgugcacaucagcccccugagcggguccgcccagcacgucgaggagugcagcugcuacccccgcuacccgggcgugcggugcaucugccgcgacaacuggaagggcuccaaccggcccguggucgacaucaacgugaaggacuacagcaucgacuccagcuacgugugcuccgggcuggucggcgacacgccccgcaacaacgaccggagcuccagcuccuacugccgcaaccccaacaacgagcgggggaaccacggcgugaaggggugggccuucgacgacggcaacgacguguggaugggccgcaccaucagcaaggacucccggagcggguacgagaccuucaaggucaucggcgggugguccaccccgaacagcaagucccagaucaaccgccaggugaucgucgacagcgacaaccgguccggcuacagcgggaucuucagcguggagggcaaguccugcaucaaccgcugcuucuacguggagcucauccgcggccgggagcaggagacccgcgucugguggaccagcaacuccaucgugguguucugcgggacgagcggcaccuacgggaccggcuccuggcccgacggggccgacaucaaccugaugcccaucuga

SEQ ID NO: 81136 - RNA, 1410 nt, Artificial Sequence; identical to SEQ ID NO: 75126
  derived and/or modified sequence opt1 from neuraminidase__InfluenzaA__ADT79021

SEQ ID NO: 81137 - RNA, 1410 nt, Artificial Sequence
  derived and/or modified sequence opt1 from neuraminidase__InfluenzaA__ADT79041
augaaccccaaccagaagaucaucaccaucggcagcgugucccugaccaucgccacggucugcuuccucaugcagaucgccauccuggugaccaccgugacccugcacuuccgccaguacgagugcgacagcccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucagcaaggacaacuccauccggcugagcgccggcggggacaucugggucacgcgcgagcccuacguguccugcgaccccggcaagugcuaccaguucgcccucgggcagggcaccacccuggacaacaagcacagcaacgacaccauccacgaccggaucccgcaccgcacgcugcucaugaacgagcugggcgugcccuuccaccuggggacccggcaggucugcaucgccugguccagcuccagcugccacgacggcaaggcguggcuccacgugugcgugaccggggacgacaagaacgccaccgccuccuucaucuacgacggccgccuggucgacagcaucggguccuggagccagaacauccugcggacgcaggaguccgagugcgugugcaucaacgggaccugcaccguggucaugaccgacggcagcgccuccggccgcgcggacacgaagauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucgaggacuacagcaucgacuccagcuacgugugcuccgggcuggugggcgacacgccccggaacaacgaccgcagcuccaacagcaacugccggaaccccaacaacgagcgcgggaaccacggcgucaaggggugggccuucgacgacggcaacgacguguggaugggccggaccaucuccaaggaccuccgcagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcugauccggggccgcgagcaggagacccgggugugguggaccagcaacuccaucgucguguucugcgggaccagcggcacguacgggaccggcuccuggcccgacggggccgacaucaaccugaugcccaucuga

SEQ ID NO: 81138 - RNA, 1410 nt, Artificial Sequence; identical to SEQ ID NO: 76768
  derived and/or modified sequence opt1 from neuraminidase__InfluenzaA__ADT79121

SEQ ID NO: 81139 - RNA, 1410 nt, Artificial Sequence
  derived and/or modified sequence opt1 from neuraminidase__InfluenzaA__ADT79131
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucgaggacuccaucggcagcuggucccagaacauccugcgcacgcaggagagcgagugcgugugcaucaacgggaccugcaccguggucaugaccgacggcuccgcgagcggccgggccgacacgcgcauccuguucaucaaggaggggaagaucgugcacaucagcccccucuccggcagcgcccagcacaucgaggagugcuccugcuacccccgguacccggacgugcgcugcaucugccgggacaacuggaagggcagcaaccgccccguccuggacaucuccauggaggacuacagcaucgacuccagcuacgugugcuccgggcuggugggcgacacgccccggaacgacgacagcuccagcaacuccaacugccgcgaccccaacaacgagcgggggaacccgggcgucaaggggugggccuucgacaacggcgacgacguguggaugggccgcaccaucagcaaggaccuccgguccggguacgagaccuucaaggugaucggcggguggagcacccccaacuccaagagccaggucaaccgccaggugaucgucgacaacaacaacugguccggcuacagcgggaucuucagcguggagggcaaguccugcaucaaccggugcuucuacguggagcugauccgcggccgcagccaggagacccgggucugguggaccuccaacagcaucgugguguucugcgggaccuccggcacguacgggaccggcagcuggcccgacggggccaacaucaacuucaugcccaucuga

SEQ ID NO: 81140 - RNA, 1410 nt, Artificial Sequence; identical to SEQ ID NO: 77746
  derived and/or modified sequence opt1 from neuraminidase__InfluenzaA__ADT79234

SEQ ID NO: 81141 - RNA, 1410 nt, Artificial Sequence; identical to SEQ ID NO: 77736
  derived and/or modified sequence opt1 from neuraminidase__InfluenzaA__ADT79244

SEQ ID NO: 81142 - RNA, 1410 nt, Artificial Sequence
  derived and/or modified sequence opt1 from neuraminidase__InfluenzaA__ADU25480
augaaccccaaccagaagaucaucaucaucagcuccaucugccugaucaacggcaucaccagccucauccugcagaucgggaacaucaucuccaucuggaucagccacuccauccagaucggcaaccagaaccagaccgagacgugcagccagaacaucaucaccuacgagaacaacaccugggugaaccagaccuacgucaacaucuccaacaacaacuucguggccgagcaggccguggucagcaugaagcuggcgggguccagcccgcucugccccguguccggcugggccaucuacagcaaggacaacuccgugcgcaucgggagcaagggcgacgucuucgugauccgggagcccuucaucuccugcagccaccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccgucgccuggagcgccuccgcgugccacgacgggacgagcuggcucaccaucggcaucuccgggcccgacaacggcgccguggccgugcugaaguacaacgacaucaucaccgacaccaucaagagcuggcgcaacaacauccugcggacgcaggaguccgagugcgucugcgugaacggcagcugcuucaccgugaugaccgacgggccguccaacggccaggccagcuacaagaucuucaagaucgagaaggggaaggucgugaaguccguggagcucaacgcgcccaacuaccacuacgaggagugcagcugcuaccccgacuccggcgagaucaucugcgucugccgcgacaacuggcacggcagcaaccggcccuggguguccuucaaccagaaccuggaguaccagaucggguacaucugcagcggcauccugggggacaacccgcgccccaacgaccggaccggcuccugcgggcccgugagccucaacggcgccaacggcgucaagggguucuccuucaaguacggcaacgggguguggaucggccgcaccaagagcagcuccagccgguccggguucgagaugaucugggaccccaacggcuggacggagaccgacaacaacuuccuggugaagcaggacaucgucggcaugaccgacuggagcggguacuccggcagcuucgugcagcacccggagcugacggggaugaacugcaugcgccccugcuucugggucgagcucauccggggccgccccaaggagaacaccaucuggaccuccgggagcuccaucagcuucugcggcgugaacuccgacaccguggacuggagcuggcccgacggcgccgagcugccguucacgaucgacaaguga

SEQ ID NO: 81143 - RNA, 1410 nt, Artificial Sequence; identical to SEQ ID NO: 77746
  derived and/or modified sequence opt1 from neuraminidase__InfluenzaA__ADU59780

SEQ ID NO: 81144 - RNA, 1410 nt, Artificial Sequence
  derived and/or modified sequence opt1 from neuraminidase__InfluenzaA__ADU59789
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacgucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81145 - RNA, 1410 nt, Artificial Sequence; identical to SEQ ID NO: 77746
  derived and/or modified sequence opt1 from neuraminidase__InfluenzaA__ADU59829

SEQ ID NO: 81146 - RNA, 1410 nt, Artificial Sequence
  derived and/or modified sequence opt1 from neuraminidase__InfluenzaA__ADU59838
augaaccccaaccagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuucgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgacugguccuggcccgacggggccgagcugccguucaccaucgacaaguga

SEQ ID NO: 81147 - RNA, 1410 nt, Artificial Sequence; identical to SEQ ID NO: 79097
  derived and/or modified sequence opt1 from neuraminidase__InfluenzaA__ADU59847

SEQ ID NO: 81148 - RNA, 1410 nt, Artificial Sequence; identical to SEQ ID NO: 77746
  derived and/or modified sequence opt1 from neuraminidase__InfluenzaA__ADU59907

SEQ ID NO: 81149 - RNA, 1410 nt, Artificial Sequence; identical to SEQ ID NO: 77746
  derived and/or modified sequence opt1 from neuraminidase__InfluenzaA__ADU59917

SEQ ID NO: 81150 - RNA, 1410 nt, Artificial Sequence; identical to SEQ ID NO: 77746
  derived and/or modified sequence opt1 from neuraminidase__InfluenzaA__ADU59920

SEQ ID NO: 81151 - RNA, 1410 nt, Artificial Sequence; identical to SEQ ID NO: 77746
  derived and/or modified sequence opt1 from neuraminidase__InfluenzaA__ADU59941

SEQ ID NO: 81152 - RNA, 1410 nt, Artificial Sequence
  derived and/or modified sequence opt1 from neuraminidase__InfluenzaA__ADU76311
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccaagcugccguucacgaucgacaaguga

SEQ ID NO: 81153 - RNA, 1410 nt, Artificial Sequence
  derived and/or modified sequence opt1 from neuraminidase__InfluenzaA__ADU76313
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccaagcugccguucacgaucgacaaguga

SEQ ID NO: 81154 - RNA, 1410 nt, Artificial Sequence; identical to SEQ ID NO: 81153
  derived and/or modified sequence opt1 from neuraminidase__InfluenzaA__ADU76314

SEQ ID NO: 81155 - RNA, 1410 nt, Artificial Sequence; identical to SEQ ID NO: 81153
  derived and/or modified sequence opt1 from neuraminidase__InfluenzaA__ADU76315

SEQ ID NO: 81156 - RNA, 1410 nt, Artificial Sequence; identical to SEQ ID NO: 81153
  derived and/or modified sequence opt1 from neuraminidase__InfluenzaA__ADU76316

SEQ ID NO: 81157 - RNA, 1410 nt, Artificial Sequence
  derived and/or modified sequence opt1 from neuraminidase__InfluenzaA__ADU76317
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaccagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 81158 - RNA, 1410 nt, Artificial Sequence
  derived and/or modified sequence opt1 from neuraminidase__InfluenzaA__ADU76318
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccacaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81159 - RNA, 1410 nt, Artificial Sequence; identical to SEQ ID NO: 78989
  derived and/or modified sequence opt1 from neuraminidase__InfluenzaA__ADU76319

SEQ ID NO: 81160 - RNA, 1410 nt, Artificial Sequence; identical to SEQ ID NO: 77746
  derived and/or modified sequence opt1 from neuraminidase__InfluenzaA__ADU76320

SEQ ID NO: 81161 - RNA, 1410 nt, Artificial Sequence; identical to SEQ ID NO: 77746
  derived and/or modified sequence opt1 from neuraminidase__InfluenzaA__ADU76321

SEQ ID NO: 81162 - RNA, 1410 nt, Artificial Sequence
  derived and/or modified sequence opt1 from neuraminidase__InfluenzaA__ADU76322
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccaucaucagcuucugcggcgucaacuccgacaccgugggguggagcuggcccgacggcgccgagcugccguucacgaucgacaaguga

SEQ ID NO: 81163 - RNA, 1410 nt, Artificial Sequence; identical to SEQ ID NO: 81152
  derived and/or modified sequence opt1 from neuraminidase__InfluenzaA__ADU76323

SEQ ID NO: 81164 - RNA, 1410 nt, Artificial Sequence; identical to SEQ ID NO: 81153
  derived and/or modified sequence opt1 from neuraminidase__InfluenzaA__ADU76324

SEQ ID NO: 81165 - RNA, 1410 nt, Artificial Sequence; identical to SEQ ID NO: 81152
  derived and/or modified sequence opt1 from neuraminidase__InfluenzaA__ADU76325

SEQ ID NO: 81166 - RNA, 1410 nt, Artificial Sequence; identical to SEQ ID NO: 81153
  derived and/or modified sequence opt1 from neuraminidase__InfluenzaA__ADU76326

SEQ ID NO: 81167 - RNA, 1410 nt, Artificial Sequence; identical to SEQ ID NO: 81153
  derived and/or modified sequence opt1 from neuraminidase__InfluenzaA__ADU76327

SEQ ID NO: 81168 - RNA, 1410 nt, Artificial Sequence; identical to SEQ ID NO: 81152
  derived and/or modified sequence opt1 from neuraminidase__InfluenzaA__ADU76328

SEQ ID NO: 81169 - RNA, 1410 nt, Artificial Sequence; identical to SEQ ID NO: 81153
  derived and/or modified sequence opt1 from neuraminidase__InfluenzaA__ADU76329

SEQ ID NO: 81170 - RNA, 1410 nt, Artificial Sequence; identical to SEQ ID NO: 81153
  derived and/or modified sequence opt1 from neuraminidase__InfluenzaA__ADU76330

SEQ ID NO: 81171 - RNA, 1410 nt, Artificial Sequence; identical to SEQ ID NO: 81153
  derived and/or modified sequence opt1 from neuraminidase__InfluenzaA__ADU76331

SEQ ID NO: 81172 - RNA, 1410 nt, Artificial Sequence; identical to SEQ ID NO: 81153
  derived and/or modified sequence opt1 from neuraminidase__InfluenzaA__ADU76332

SEQ ID NO: 81173 - RNA, 1410 nt, Artificial Sequence; identical to SEQ ID NO: 77746
  derived and/or modified sequence opt1 from neuraminidase__InfluenzaA__ADU76333

SEQ ID NO: 81174 - RNA, 1410 nt, Artificial Sequence; identical to SEQ ID NO: 77746
  derived and/or modified sequence opt1 from neuraminidase__InfluenzaA__ADU76334

SEQ ID NO: 81175 - RNA, 1410 nt, Artificial Sequence; identical to SEQ ID NO: 77746
  derived and/or modified sequence opt1 from neuraminidase__InfluenzaA__ADU76335

SEQ ID NO: 81176 - RNA, 1410 nt, Artificial Sequence; identical to SEQ ID NO: 81153
  derived and/or modified sequence opt1 from neuraminidase__InfluenzaA__ADU76336

SEQ ID NO: 81177 - RNA, 1410 nt, Artificial Sequence; identical to SEQ ID NO: 78513
  derived and/or modified sequence opt1 from neuraminidase__InfluenzaA__ADU76337

SEQ ID NO: 81178 - RNA, 1410 nt, Artificial Sequence; identical to SEQ ID NO: 79648
  derived and/or modified sequence opt1 from neuraminidase__InfluenzaA__ADU76338

SEQ ID NO: 81179 - RNA, 1410 nt, Artificial Sequence; identical to SEQ ID NO: 81152
  derived and/or modified sequence opt1 from neuraminidase__InfluenzaA__ADU76339

SEQ ID NO: 81180 - RNA, 1410 nt, Artificial Sequence; identical to SEQ ID NO: 77746
  derived and/or modified sequence opt1 from neuraminidase__InfluenzaA__ADU76341

SEQ ID NO: 81181 - RNA, 1410 nt, Artificial Sequence; identical to SEQ ID NO: 77746
  derived and/or modified sequence opt1 from neuraminidase__InfluenzaA__ADU76342

SEQ ID NO: 81182 - RNA, 1410 nt, Artificial Sequence; identical to SEQ ID NO: 77746
  derived and/or modified sequence opt1 from neuraminidase__InfluenzaA__ADU76343

SEQ ID NO: 81183 - RNA, 1410 nt, Artificial Sequence; identical to SEQ ID NO: 81153
  derived and/or modified sequence opt1 from neuraminidase__InfluenzaA__ADU76344

SEQ ID NO: 81184 - RNA, 1410 nt, Artificial Sequence; identical to SEQ ID NO: 81153
  derived and/or modified sequence opt1 from neuraminidase__InfluenzaA__ADU76345

SEQ ID NO: 81185 - RNA, 1410 nt, Artificial Sequence
  derived and/or modified sequence opt1 from neuraminidase__InfluenzaA__ADU76346
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 81186 - RNA, 1410 nt, Artificial Sequence; identical to SEQ ID NO: 78513
  derived and/or modified sequence opt1 from neuraminidase__InfluenzaA__ADU76347

SEQ ID NO: 81187 - RNA, 1410 nt, Artificial Sequence
  derived and/or modified sequence opt1 from neuraminidase__InfluenzaA__ADV17285
augaaccccaaccaggagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuuccgcuacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 81188 - RNA, 1410 nt, Artificial Sequence; identical to SEQ ID NO: 77746
  derived and/or modified sequence opt1 from neuraminidase__InfluenzaA__ADV17295

SEQ ID NO: 81189 - RNA, 1410 nt, Artificial Sequence
  derived and/or modified sequence opt1 from neuraminidase__InfluenzaA__ADV17305
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggcuccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggccccuccgacggccaggccagcuacaagaucuuccgcaucgagaaggggaagaucgugaaguccgucgagaugaacgcccccaacuaccacuacgaggagugcagcugcuacccggacuccagcgagaucacgugcgugugccgggacaacuggcacggcuccaaccgccccugggugagcuucaaccagaaccucgaguaccagaucggguacaucugcuccggcaucuucggggacaacccccggcccaacgacaagaccggcagcugcggcccggucuccagcaacggggccaacggcgugaagggguucagcuucaaguacggcaacgggguguggaucggccgcaccaaguccaucagcucccggaacggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgccccugcuucuggguggagcucauccggggccgcccgaaggagaacaccaucuggaccagcggguccagcaucuccuucugcggcgucaacagcgacaccguggggugguccuggcccgacggcgccgagcugcccuucacgaucgacaaguga

SEQ ID NO: 81190 - RNA, 1410 nt, Artificial Sequence; identical to SEQ ID NO: 77746
  derived and/or modified sequence opt1 from neuraminidase__InfluenzaA__ADV17315

SEQ ID NO: 81191 - RNA, 1410 nt, Artificial Sequence; identical to SEQ ID NO: 79177
  derived and/or modified sequence opt1 from neuraminidase__InfluenzaA__ADV17325

SEQ ID NO: 81192 - RNA, 1410 nt, Artificial Sequence
  derived and/or modified sequence opt1 from neuraminidase__InfluenzaA__ADV17335
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcguguucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagugcccguucacgaucgacaaguga

SEQ ID NO: 81193 - RNA, 1410 nt, Artificial Sequence; identical to SEQ ID NO: 77746
  derived and/or modified sequence opt1 from neuraminidase__InfluenzaA__ADV19022

SEQ ID NO: 81194 - RNA, 1410 nt, Artificial Sequence
  derived and/or modified sequence opt1 from neuraminidase__InfluenzaA__ADV41679
augaaccccaaccagaagaucaucaccaucggcagcgugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcagcugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 81195 - RNA, 1410 nt, Artificial Sequence
  derived and/or modified sequence opt1 from neuraminidase__InfluenzaA__ADV76582
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgacaagggcaaccgguccggguacagcggcaucuucuccguggagggcaagagcugcaucaaccgcugcuucuacguggagcucauccgggggcgcaaggaggagaccgagguccuguggaccagcaacuccaucgugguguucugcggcacgagcgggaccuacggcaccggguccuggccggacggcgccgaccugaaccucaugcccaucuga

SEQ ID NO: 81196 - RNA, 1410 nt, Artificial Sequence; identical to SEQ ID NO: 77607
  derived and/or modified sequence opt1 from neuraminidase__InfluenzaA__ADV76590

SEQ ID NO: 81197 - RNA, 1410 nt, Artificial Sequence; identical to SEQ ID NO: 77607
  derived and/or modified sequence opt1 from neuraminidase__InfluenzaA__ADV76601

SEQ ID NO: 81198 - RNA, 1410 nt, Artificial Sequence; identical to SEQ ID NO: 78600
  derived and/or modified sequence opt1 from neuraminidase__InfluenzaA__ADV76612

SEQ ID NO: 81199 - RNA, 1410 nt, Artificial Sequence; identical to SEQ ID NO: 77607
  derived and/or modified sequence opt1 from neuraminidase__InfluenzaA__ADV76623

SEQ ID NO: 81200 - RNA, 1410 nt, Artificial Sequence; identical to SEQ ID NO: 77607
  derived and/or modified sequence opt1 from neuraminidase__InfluenzaA__ADV76634

SEQ ID NO: 81201 - RNA, 1410 nt, Artificial Sequence; identical to SEQ ID NO: 80474
  derived and/or modified sequence opt1 from neuraminidase__InfluenzaA__ADV76645

SEQ ID NO: 81202 - RNA, 1410 nt, Artificial Sequence
  derived and/or modified sequence opt1 from neuraminidase__InfluenzaA__ADV76667
augaaccccaaccagaagaucaucaccaucggcagcgugucccugaccaucgccacggucugcuuccucaugcagaucgccauccuggugaccaccgugacccugcacuucaagcaguacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccagcuccugccacgacggcaaggcguggcugcacgugugcaucaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgccagcggccgggcggacacgcgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaagagccggaaccccaacaacgagcgcgggaaccagggcgugaaggggugggccuucgacaacggcgacgacgucuggaugggccggaccaucucccgcgaccugcggagcggguacgagaccuucaaggugaucggcgggugguccacccccaacagcaagucccagaucaaccgccaggucaucguggacagcgacaaccgcuccggcuacagcgggaucuucagcguggagggcaaguccugcaucaaccggugcuucuacgucgagcucauccgcggccggaagcaggagacccgcgugugguggaccagcaacuccaucguggucuucugcgggaccagcggcacguacgggaccggcuccuggccggacggggccaacaucaacuucaugcccaucuga

SEQ ID NO: 81203 - RNA, 1410 nt, Artificial Sequence; identical to SEQ ID NO: 80476
  derived and/or modified sequence opt1 from neuraminidase__InfluenzaA__ADV76676

SEQ ID NO: 81204 - RNA, 1410 nt, Artificial Sequence; identical to SEQ ID NO: 79617
  derived and/or modified sequence opt1 from neuraminidase__InfluenzaA__ADV76697

SEQ ID NO: 81205 - RNA, 1410 nt, Artificial Sequence
  derived and/or modified sequence opt1 from neuraminidase__InfluenzaA__ADV76708
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacaucacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81206 - RNA, 1410 nt, Artificial Sequence
  derived and/or modified sequence opt1 from neuraminidase__InfluenzaA__ADV76719
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaugaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81207 - RNA, 1410 nt, Artificial Sequence
  derived and/or modified sequence opt1 from neuraminidase__InfluenzaA__ADV76730
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagacccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaaggacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 81208 - RNA, 1410 nt, Artificial Sequence
  derived and/or modified sequence opt1 from neuraminidase__InfluenzaA__ADV78132
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucagcgugaagcucgccgggaacuccagccugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacagcaacgggaccaucaaggaccggucccccuaccgcacgcugaugagcugcccgaucggcgaggugcccagccccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccgugggcaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucagcuucaaguacgggaacggcguguggaucggccgcaccaaguccaucagcucccggaagggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucugggccagcggcuccagcaucuccuucugcggggugaacagcgacaccgucggcugguccuggcccgacggcgcggagcugccguucaucaucgacaaguga

SEQ ID NO: 81209 - RNA, 1413 nt, Artificial Sequence
  derived and/or modified sequence opt1 from neuraminidase__InfluenzaA__ADW09104
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccaacaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacugguccggguacagcggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 81210 - RNA, 1413 nt, Artificial Sequence; identical to SEQ ID NO: 78469
  derived and/or modified sequence opt1 from neuraminidase__InfluenzaA__ADW09114

SEQ ID NO: 81211 - RNA, 1413 nt, Artificial Sequence
  derived and/or modified sequence opt1 from neuraminidase__InfluenzaA__ADW09123
augaaccccaaccagaagaucaucaccaucggcagcaucuccaucgccaucgggaucaccagccugaugcuccagaucggcaacaucaucuccaucugggccagccacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 81212 - RNA, 1413 nt, Artificial Sequence
  derived and/or modified sequence opt1 from neuraminidase__InfluenzaA__ADW09156
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81213 - RNA, 1413 nt, Artificial Sequence
  derived and/or modified sequence opt1 from neuraminidase__InfluenzaA__ADW09167
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81214 - RNA, 1413 nt, Artificial Sequence; identical to SEQ ID NO: 78469
  derived and/or modified sequence opt1 from neuraminidase__InfluenzaA__ADW09178

SEQ ID NO: 81215 - RNA, 1413 nt, Artificial Sequence; identical to SEQ ID NO: 78469
  derived and/or modified sequence opt1 from neuraminidase__InfluenzaA__ADW09189

SEQ ID NO: 81216 - RNA, 1413 nt, Artificial Sequence; identical to SEQ ID NO: 81213
  derived and/or modified sequence opt1 from neuraminidase__InfluenzaA__ADW09211

SEQ ID NO: 81217 - RNA, 1413 nt, Artificial Sequence
  derived and/or modified sequence opt1 from neuraminidase__InfluenzaA__ADW09222
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacagcgugaccguggacggcgcggacggggucaagggcuucuccuacaaguacggcaacgggguguggaucggccgcaccaagagcaaccggcugcgcaagggguucgagaugaucugggacccgaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccccgggagaacaccaccaucuggaccuccggcagcuccaucagcuucugcggggucaacuccgacacggccaacuggagcuggccggacggcgccgagcugcccuucaccaucgacaaguga

SEQ ID NO: 81218 - RNA, 1413 nt, Artificial Sequence
  derived and/or modified sequence opt1 from neuraminidase__InfluenzaA__ADW09233
augaaccccaaccagaagaucaucaccaucggcagcaucuccaucgccaucgggaccaucagccugaugcuccagaucggcaacaucaucuccaucugggccagccacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 81219 - RNA, 1413 nt, Artificial Sequence; identical to SEQ ID NO: 81212
  derived and/or modified sequence opt1 from neuraminidase__InfluenzaA__ADW09244

SEQ ID NO: 81220 - RNA, 1413 nt, Artificial Sequence; identical to SEQ ID NO: 81212
  derived and/or modified sequence opt1 from neuraminidase__InfluenzaA__ADW09255

SEQ ID NO: 81221 - RNA, 1413 nt, Artificial Sequence; identical to SEQ ID NO: 81212
  derived and/or modified sequence opt1 from neuraminidase__InfluenzaA__ADW09266

SEQ ID NO: 81222 - RNA, 1413 nt, Artificial Sequence; identical to SEQ ID NO: 81212
  derived and/or modified sequence opt1 from neuraminidase__InfluenzaA__ADW09277

SEQ ID NO: 81223 - RNA, 1413 nt, Artificial Sequence; identical to SEQ ID NO: 78469
  derived and/or modified sequence opt1 from neuraminidase__InfluenzaA__ADW09288

SEQ ID NO: 81224 - RNA, 1413 nt, Artificial Sequence; identical to SEQ ID NO: 81213
  derived and/or modified sequence opt1 from neuraminidase__InfluenzaA__ADW09299

SEQ ID NO: 81225 - RNA, 1413 nt, Artificial Sequence; identical to SEQ ID NO: 78469
  derived and/or modified sequence opt1 from neuraminidase__InfluenzaA__ADW09310

SEQ ID NO: 81226 - RNA, 1413 nt, Artificial Sequence; identical to SEQ ID NO: 78469
  derived and/or modified sequence opt1 from neuraminidase__InfluenzaA__ADW09330

SEQ ID NO: 81227 - RNA, 1413 nt, Artificial Sequence; identical to SEQ ID NO: 81212
  derived and/or modified sequence opt1 from neuraminidase__InfluenzaA__ADW10475

SEQ ID NO: 81228 - RNA, 1413 nt, Artificial Sequence; identical to SEQ ID NO: 81213
  derived and/or modified sequence opt1 from neuraminidase__InfluenzaA__ADW10486

SEQ ID NO: 81229 - RNA, 1413 nt, Artificial Sequence; identical to SEQ ID NO: 78469
  derived and/or modified sequence opt1 from neuraminidase__InfluenzaA__ADW10497

SEQ ID NO: 81230 - RNA, 1413 nt, Artificial Sequence
  derived and/or modified sequence opt1 from neuraminidase__InfluenzaA__ADW10508
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccuggucaacgacaagcacuccaacggcaccgugaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcggucgccgugcucaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagagcaucgagcugaacgcccccaacuucuacuacgaggagugcuccugcuacccggacaccggcaucgugaugugcgugugccgggacaacuggcacgggagcaaccgccccugggucuccuucaaccagaaccucgacuaccagaucggcuacaucugcagcggcguguucggggacaacccccggcccgaggacggcgagggguccugcaacccggugaccgucaacggcgcggacggggugaagggcuucagcuacaaguacggcaacgggguguggaucggccgcacgaaguccaaccggcugcgcaagggguucgagaugaucugggaccccaacggcuggaccaacaccgacagcgacuucuccgucaagcaggacgugguggccaucaccgacuggagcggguacagcggcuccuucguccagcaccccgagcugacgggccucgacugcauccggcccugcuucuggguggagcugguccgcgggcugccgcgggagaacaccaccaucuggaccagcggcuccagcaucuccuucugcggggugaacagcgacacggccaacugguccuggcccgacggcgccgagcuccccuucaccaucgacaaguga

SEQ ID NO: 81231 - RNA, 1413 nt, Artificial Sequence; identical to SEQ ID NO: 78469
  derived and/or modified sequence opt1 from neuraminidase__InfluenzaA__ADW10519

SEQ ID NO: 81232 - RNA, 1413 nt, Artificial Sequence; identical to SEQ ID NO: 78469
  derived and/or modified sequence opt1 from neuraminidase__InfluenzaA__ADW10530

SEQ ID NO: 81233 - RNA, 1413 nt, Artificial Sequence
  derived and/or modified sequence opt1 from neuraminidase__InfluenzaA__ADW10541
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcauggacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81234 - RNA, 1413 nt, Artificial Sequence
  derived and/or modified sequence opt1 from neuraminidase__InfluenzaA__ADW10552
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccgacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81235 - RNA, 1413 nt, Artificial Sequence; identical to SEQ ID NO: 80945
  derived and/or modified sequence opt1 from neuraminidase__InfluenzaA__ADW10563

SEQ ID NO: 81236 - RNA, 1413 nt, Artificial Sequence; identical to SEQ ID NO: 78469
  derived and/or modified sequence opt1 from neuraminidase__InfluenzaA__ADW10574

SEQ ID NO: 81237 - RNA, 1413 nt, Artificial Sequence
  derived and/or modified sequence opt1 from neuraminidase__InfluenzaA__ADW10585
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaaguccgucacccuggccggcaacagcucccugugcagcaucuccggcugggccaucuacaccaaggacaacagcauccggaucggguccaagggcgacguguucgugauccgcgagccguucaucagcugcucccaccucgagugccggaccuucuuccugacgcagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucaccggcacgaucaagagcuggaagaagcagauccugcgcacccaggaguccgagugcgugugcaugaacgggagcugcuucaccaucaugaccgacggccccuccaacaaggccgccagcuacaagaucuucaagaucgagaaggggaaggugacgaaguccaucgagcucaacgcccccaacuucuacuacgaggagugcagcugcuacccggacaccggcaucgucaugugcgugugccgggacaacuggcacggguccaaccgccccugggugagcuucaaccagaaccuggaguaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcagcuccaucagcuucugcggggucaacuccgacaccgccaacuggagcuggcccgacggcgccgagcugcccuucacgaucgacaaguga

SEQ ID NO: 81238 - RNA, 1413 nt, Artificial Sequence; identical to SEQ ID NO: 81213
  derived and/or modified sequence opt1 from neuraminidase__InfluenzaA__ADW10596

SEQ ID NO: 81239 - RNA, 1413 nt, Artificial Sequence; identical to SEQ ID NO: 81212
  derived and/or modified sequence opt1 from neuraminidase__InfluenzaA__ADW10607

SEQ ID NO: 81240 - RNA, 1413 nt, Artificial Sequence; identical to SEQ ID NO: 81212
  derived and/or modified sequence opt1 from neuraminidase__InfluenzaA__ADW10618

SEQ ID NO: 81241 - RNA, 1413 nt, Artificial Sequence; identical to SEQ ID NO: 81212
  derived and/or modified sequence opt1 from neuraminidase__InfluenzaA__ADW10629

SEQ ID NO: 81242 - RNA, 1413 nt, Artificial Sequence; identical to SEQ ID NO: 81212
  derived and/or modified sequence opt1 from neuraminidase__InfluenzaA__ADW10724

SEQ ID NO: 81243 - RNA, 1413 nt, Artificial Sequence; identical to SEQ ID NO: 81213
  derived and/or modified sequence opt1 from neuraminidase__InfluenzaA__ADW10735

SEQ ID NO: 81244 - RNA, 1413 nt, Artificial Sequence; identical to SEQ ID NO: 81213
  derived and/or modified sequence opt1 from neuraminidase__InfluenzaA__ADW10746

SEQ ID NO: 81245 - RNA, 1413 nt, Artificial Sequence
  derived and/or modified sequence opt1 from neuraminidase__InfluenzaA__ADW10757
augaaccccaaccagaagaucaucaccaucggcagcaucuccaucgccaucgggaucaucagccugaugcuccagaucggcaacaucaucuccaucugggccagccacuccauccagacccgcagccagaacaacacggggaucugcaaccagcggaucaucaccuacgagaacuccaccugggugaaccacaccuacgucaacaucaacaacacgaacgugguggcgggcggggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagagcgagugcgugugcaugaacggguccugcuucacccucaugacggacggccccagcaacaaggccgccuccuacaagaucuucaagaucgagaaggggaaggugaccaagagcaucgagcugaacgcccccaacuucuacuacgaggagugcuccugcuacccggacaccggcaucgucaugugcgugugccgcgacaacuggcacgggagcaaccggcccuggguguccuucaaccagaaccuggacuaccagaucggcuacaucugcagcggcgucuucggggacaacccccgccccgaggacggcgagggguccugcaacccggugaccguggacggcgcgaacggggucaagggcuucagcuacaaguacggcaacgggguguggaucggccggacgaaguccaaccgccuccggaagggguucgagaugaucugggaccccaacggcuggaccaacaccgacagcgacuucuccgugaagcaggacgucguggccaucaccgacuggagcggguacagcggcuccuucgugcagcaccccgagcugacgggccuggacugcauccgccccugcuucugggucgagcucgugcgggggcugccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 81246 - RNA, 1413 nt, Artificial Sequence; identical to SEQ ID NO: 81212
  derived and/or modified sequence opt1 from neuraminidase__InfluenzaA__ADW10768

SEQ ID NO: 81247 - RNA, 1413 nt, Artificial Sequence; identical to SEQ ID NO: 78469
  derived and/or modified sequence opt1 from neuraminidase__InfluenzaA__ADW10779

SEQ ID NO: 81248 - RNA, 1413 nt, Artificial Sequence
  derived and/or modified sequence opt1 from neuraminidase__InfluenzaA__ADW10790
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcaucauccccugcuucugggucgagcuggugcgggggcucccgcgcgagaacgccaccaucuggaccagcggcuccagcaucuccuucugcggggucaacagcgacaccgccaacugguccuggcccgacggcgccgagcugcccuucacgaucgacaaguga

SEQ ID NO: 81249 - RNA, 1413 nt, Artificial Sequence; identical to SEQ ID NO: 79938
  derived and/or modified sequence opt1 from neuraminidase__InfluenzaA__ADW10801

SEQ ID NO: 81250 - RNA, 1413 nt, Artificial Sequence; identical to SEQ ID NO: 81212
  derived and/or modified sequence opt1 from neuraminidase__InfluenzaA__ADW10812

SEQ ID NO: 81251 - RNA, 1413 nt, Artificial Sequence; identical to SEQ ID NO: 80964
  derived and/or modified sequence opt1 from neuraminidase__InfluenzaA__ADW10823

SEQ ID NO: 81252 - RNA, 1413 nt, Artificial Sequence
  derived and/or modified sequence opt1 from neuraminidase__InfluenzaA__ADW10834
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaucaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 81253 - RNA, 1413 nt, Artificial Sequence; identical to SEQ ID NO: 81213
  derived and/or modified sequence opt1 from neuraminidase__InfluenzaA__ADW10845

SEQ ID NO: 81254 - RNA, 1413 nt, Artificial Sequence
  derived and/or modified sequence opt1 from neuraminidase__InfluenzaA__ADW10856
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccgcaucgggagcaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccguggccuggagcgccuccgcgugccacgacggcaugggcuggcucaccaucgggaucagcggccccgacaacggggccgucgccgugcugaaguacaacggcaucaucacgggcaccaucaaguccuggaagaagcagauccugcggacccaggagagcgagugcgugugcaugaacggguccugcuucaccaucaugacggacggccccagcaacaaggccgccuccuacaagaucuucaagaucgagaaggggaaggucaccaagagcaucgagcucaacgcgcccaacuucuacuacgaggagugcuccugcuacccggacaccggcaucgugaugugcgugugccgcgacaacuggcacgggagcaaccggcccugggucuccuucaaccagaaccuggacuaccagaucggcuacaucugcagcggcguguucggggacaacccccgccccgaggacggcgagggguccugcaacccggugaccgucgacggcgccaacggggugaagggcuucagcuacaaguacggcaacgggguguggaucggccggacgaaguccaaccgccugcggaagggguucgagaugaucugggaccccaacggcuggaccaacaccgacagcgacuucuccgucaagcaggacgugguggccaucaccgacuggagcggguacagcggcuccuucguccagcaccccgagcucacgggccuggacugcauccgccccugcuucuggguggagcuggugcgggggcucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 81255 - RNA, 1413 nt, Artificial Sequence; identical to SEQ ID NO: 81212
  derived and/or modified sequence opt1 from neuraminidase__InfluenzaA__ADW10867

SEQ ID NO: 81256 - RNA, 1413 nt, Artificial Sequence; identical to SEQ ID NO: 81212
  derived and/or modified sequence opt1 from neuraminidase__InfluenzaA__ADW10878

SEQ ID NO: 81257 - RNA, 1413 nt, Artificial Sequence; identical to SEQ ID NO: 81212
  derived and/or modified sequence opt1 from neuraminidase__InfluenzaA__ADW10889

SEQ ID NO: 81258 - RNA, 1413 nt, Artificial Sequence; identical to SEQ ID NO: 78469
  derived and/or modified sequence opt1 from neuraminidase__InfluenzaA__ADW10900

SEQ ID NO: 81259 - RNA, 1410 nt, Artificial Sequence; identical to SEQ ID NO: 79492
  derived and/or modified sequence opt1 from neuraminidase__InfluenzaA__ADW11155

SEQ ID NO: 81260 - RNA, 1410 nt, Artificial Sequence; identical to SEQ ID NO: 77746
  derived and/or modified sequence opt1 from neuraminidase__InfluenzaA__ADW23530

SEQ ID NO: 81261 - RNA, 1410 nt, Artificial Sequence
  derived and/or modified sequence opt1 from neuraminidase__InfluenzaA__ADW54483
augaaccccaaccagaagaucaucaccaucggcagcgugugcaugaccaucgggauggccaaccugaugcuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81262 - RNA, 1410 nt, Artificial Sequence
  derived and/or modified sequence opt1 from neuraminidase__InfluenzaA__ADW54494
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 81263 - RNA, 1410 nt, Artificial Sequence
  derived and/or modified sequence opt1 from neuraminidase__InfluenzaA__ADW54514
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccgcaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81264 - RNA, 1410 nt, Artificial Sequence
  derived and/or modified sequence opt1 from neuraminidase__InfluenzaA__ADW54522
augaaccccaaccagaagaucaucaccaucggcagcgugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaaccggcugcgcacccaggaguccgagugcgcgugcgugaacgggagcugcuucacggugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaagggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 81265 - RNA, 1410 nt, Artificial Sequence
  derived and/or modified sequence opt1 from neuraminidase__InfluenzaA__ADW65826
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81266 - RNA, 1410 nt, Artificial Sequence; identical to SEQ ID NO: 77607
  derived and/or modified sequence opt1 from neuraminidase__InfluenzaA__ADW80519

SEQ ID NO: 81267 - RNA, 1410 nt, Artificial Sequence; identical to SEQ ID NO: 77607
  derived and/or modified sequence opt1 from neuraminidase__InfluenzaA__ADW82127

SEQ ID NO: 81268 - RNA, 1410 nt, Artificial Sequence; identical to SEQ ID NO: 77607
  derived and/or modified sequence opt1 from neuraminidase__InfluenzaA__ADW82138

SEQ ID NO: 81269 - RNA, 1410 nt, Artificial Sequence; identical to SEQ ID NO: 77607
  derived and/or modified sequence opt1 from neuraminidase__InfluenzaA__ADW82149

SEQ ID NO: 81270 - RNA, 1410 nt, Artificial Sequence; identical to SEQ ID NO: 77607
  derived and/or modified sequence opt1 from neuraminidase__InfluenzaA__ADW82158

SEQ ID NO: 81271 - RNA, 1410 nt, Artificial Sequence; identical to SEQ ID NO: 77607
  derived and/or modified sequence opt1 from neuraminidase__InfluenzaA__ADW82169

SEQ ID NO: 81272 - RNA, 1410 nt, Artificial Sequence; identical to SEQ ID NO: 77607
  derived and/or modified sequence opt1 from neuraminidase__InfluenzaA__ADW82180

SEQ ID NO: 81273 - RNA, 1410 nt, Artificial Sequence; identical to SEQ ID NO: 77746
  derived and/or modified sequence opt1 from neuraminidase__InfluenzaA__ADW82191

SEQ ID NO: 81274 - RNA, 1410 nt, Artificial Sequence; identical to SEQ ID NO: 77746
  derived and/or modified sequence opt1 from neuraminidase__InfluenzaA__ADW82201

SEQ ID NO: 81275 - RNA, 1410 nt, Artificial Sequence; identical to SEQ ID NO: 77746
  derived and/or modified sequence opt1 from neuraminidase__InfluenzaA__ADW82211

SEQ ID NO: 81276 - RNA, 1410 nt, Artificial Sequence; identical to SEQ ID NO: 77746
  derived and/or modified sequence opt1 from neuraminidase__InfluenzaA__ADW82221

SEQ ID NO: 81277 - RNA, 1410 nt, Artificial Sequence; identical to SEQ ID NO: 77746
  derived and/or modified sequence opt1 from neuraminidase__InfluenzaA__ADW82231

SEQ ID NO: 81278 - RNA, 1410 nt, Artificial Sequence; identical to SEQ ID NO: 77746
  derived and/or modified sequence opt1 from neuraminidase__InfluenzaA__ADW82241

SEQ ID NO: 81279 - RNA, 1410 nt, Artificial Sequence; identical to SEQ ID NO: 77746
  derived and/or modified sequence opt1 from neuraminidase__InfluenzaA__ADW82251

SEQ ID NO: 81280 - RNA, 1410 nt, Artificial Sequence; identical to SEQ ID NO: 77746
  derived and/or modified sequence opt1 from neuraminidase__InfluenzaA__ADW82261

SEQ ID NO: 81281 - RNA, 1410 nt, Artificial Sequence; identical to SEQ ID NO: 77746
  derived and/or modified sequence opt1 from neuraminidase__InfluenzaA__ADW82271

SEQ ID NO: 81282 - RNA, 1410 nt, Artificial Sequence; identical to SEQ ID NO: 81265
  derived and/or modified sequence opt1 from neuraminidase__InfluenzaA__ADW95306

SEQ ID NO: 81283 - RNA, 1410 nt, Artificial Sequence; identical to SEQ ID NO: 81265
  derived and/or modified sequence opt1 from neuraminidase__InfluenzaA__ADW95313

SEQ ID NO: 81284 - RNA, 1410 nt, Artificial Sequence; identical to SEQ ID NO: 81265
  derived and/or modified sequence opt1 from neuraminidase__InfluenzaA__ADW95320

SEQ ID NO: 81285 - RNA, 1410 nt, Artificial Sequence; identical to SEQ ID NO: 81265
  derived and/or modified sequence opt1 from neuraminidase__InfluenzaA__ADW95327

SEQ ID NO: 81286 - RNA, 1410 nt, Artificial Sequence
  derived and/or modified sequence opt1 from neuraminidase__InfluenzaA__ADW95333
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggcagcgccaaguccaucagcucccgcaaggcguucgagaugaucugggaccccaacggcuggaccgggaccgacaacaacuucagcaucaagcaguacaucgucggcaucaacgagugguccggguacagcggcuccuucguggagcacccggagcugaccgggcuggacugcauccggcccugcuucuggguggagcucauccgcggccggcccaaggagaacacgaucuggaccagcggcuccagcaucuccuucugcggggucaacagcgacaccgugggcugguccuggcccgacggggccgagcugccguucaccaucgacaaguga

SEQ ID NO: 81287 - RNA, 1410 nt, Artificial Sequence
  derived and/or modified sequence opt1 from neuraminidase__InfluenzaA__ADX20813
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagcucguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccagaccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaagggcuucgagaugaucugggaccccaacggguggaccggcacggacaacaacuucuccaucaagcaggacaucguggggaucaacgaguggagcggcuacuccgggagcuucgugcagcacccggagcugaccggccucgacugcauccgccccugcuucugggucgagcugauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 81288 - RNA, 1410 nt, Artificial Sequence
  derived and/or modified sequence opt1 from neuraminidase__InfluenzaA__ADX20814
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81289 - RNA, 1410 nt, Artificial Sequence; identical to SEQ ID NO: 77607
  derived and/or modified sequence opt1 from neuraminidase__InfluenzaA__ADX21091

SEQ ID NO: 81290 - RNA, 1410 nt, Artificial Sequence; identical to SEQ ID NO: 77746
  derived and/or modified sequence opt1 from neuraminidase__InfluenzaA__ADX21101

SEQ ID NO: 81291 - RNA, 1410 nt, Artificial Sequence; identical to SEQ ID NO: 78613
  derived and/or modified sequence opt1 from neuraminidase__InfluenzaA__ADX36112

SEQ ID NO: 81292 - RNA, 1410 nt, Artificial Sequence
  derived and/or modified sequence opt1 from neuraminidase__InfluenzaA__ADX87386
augaaccccaaccagcgcaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccguguga

SEQ ID NO: 81293 - RNA, 1410 nt, Artificial Sequence
  derived and/or modified sequence opt1 from neuraminidase__InfluenzaA__ADX96270
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggccuccgucaagcuggccgggaacagcucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 81294 - RNA, 1410 nt, Artificial Sequence; identical to SEQ ID NO: 81293
  derived and/or modified sequence opt1 from neuraminidase__InfluenzaA__ADX96280

SEQ ID NO: 81295 - RNA, 1410 nt, Artificial Sequence; identical to SEQ ID NO: 78329
  derived and/or modified sequence opt1 from neuraminidase__InfluenzaA__ADX96290

SEQ ID NO: 81296 - RNA, 1410 nt, Artificial Sequence; identical to SEQ ID NO: 77746
  derived and/or modified sequence opt1 from neuraminidase__InfluenzaA__ADX96300

SEQ ID NO: 81297 - RNA, 1410 nt, Artificial Sequence; identical to SEQ ID NO: 77746
  derived and/or modified sequence opt1 from neuraminidase__InfluenzaA__ADX96310

SEQ ID NO: 81298 - RNA, 1410 nt, Artificial Sequence
  derived and/or modified sequence opt1 from neuraminidase__InfluenzaA__ADX96330
augaaccccaaccagaagaucaucaccaucggcagcgugugcaugaccaucgggauggccaaccugauccuccagaucggcaacgggaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccaacgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 81299 - RNA, 1410 nt, Artificial Sequence; identical to SEQ ID NO: 77746
  derived and/or modified sequence opt1 from neuraminidase__InfluenzaA__ADX96339

SEQ ID NO: 81300 - RNA, 1410 nt, Artificial Sequence
  derived and/or modified sequence opt1 from neuraminidase__InfluenzaA__ADX96349
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccaacgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81301 - RNA, 1410 nt, Artificial Sequence; identical to SEQ ID NO: 77746
  derived and/or modified sequence opt1 from neuraminidase__InfluenzaA__ADX96359

SEQ ID NO: 81302 - RNA, 1410 nt, Artificial Sequence; identical to SEQ ID NO: 77746
  derived and/or modified sequence opt1 from neuraminidase__InfluenzaA__ADX96369

SEQ ID NO: 81303 - RNA, 1410 nt, Artificial Sequence
  derived and/or modified sequence opt1 from neuraminidase__InfluenzaA__ADX96380
augaaccccaaccagaagaucaucaccaucggcagcgugugcaugaccaucgggauggccaaccugauccuccagaucggcaacaucaucuccaucuggccgguccacagcauccagcuggggaaccagaaccagaucgagacgugcaaccaguccgugaucaccuacgagaacaacaccugggugaaccagaccuacgucaacaucagcaacacgaacuucgccgcgggccaguccguggugagcaugaagcuggccgggaacuccagccucugccccgucggcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccgguccccguaccgcacgcugaugagcugccccaucggggaggugcccucccccuacaacagccgguucgaguccguggccuggagcgcgagcgccugccacgacggcaucaacuggcucaccaucggcaucuccgggccggacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggccccuccgacgggcaggccagcuacaagaucuuccgcaucgagaagggcaagaucguggaguccguggagaugaacgcccccaacuaccacuacgaggagugcagcugcuaccccgacuccagcgagaucacgugcgucugccgggacaacuggcacggguccaaccgcccgugggugagcuucaaccagaaccucgaguaccagaucggcuacaucugcuccgggaucuucggcgacaacccccggcccaacgacaagaccggcagcugcgggcccguguccagcaacggcgccaacggggucaagggcuucuccuucaaguacgggaacggcguguggaucggccgcaccaagagcaucuccagccggaacggguucgagaugaucugggacccgaacggcuggaccgggaccgacaacaacuucagcaucaagcaggacaucgugggcaucaacgagugguccggguacagcggcuccuucguccagcaccccgagcugacgggccuggacugcauccgccccugcuucuggguggagcucauccgggggcgccccaaggagaacaccaucuggaccagcggcuccagcaucuccuucugcggggucaacagcgacaccgugggcugguccuggccggacggcgccgagcugcccuucacgaucgacaaguga

SEQ ID NO: 81304 - RNA, 1410 nt, Artificial Sequence
  derived and/or modified sequence opt1 from neuraminidase__InfluenzaA__ADX96390
augaaccccaaccagaagaucaucaccaucggcagcgugugcaugaccaucgggauggccaaccugauccuccagaucggcaacaucaucuccaucuggcugagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81305 - RNA, 1410 nt, Artificial Sequence; identical to SEQ ID NO: 77746
  derived and/or modified sequence opt1 from neuraminidase__InfluenzaA__ADX96400

SEQ ID NO: 81306 - RNA, 1410 nt, Artificial Sequence; identical to SEQ ID NO: 77746
  derived and/or modified sequence opt1 from neuraminidase__InfluenzaA__ADX96410

SEQ ID NO: 81307 - RNA, 1410 nt, Artificial Sequence; identical to SEQ ID NO: 77746
  derived and/or modified sequence opt1 from neuraminidase__InfluenzaA__ADX96419

SEQ ID NO: 81308 - RNA, 1410 nt, Artificial Sequence
  derived and/or modified sequence opt1 from neuraminidase__InfluenzaA__ADX96429
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgugcgcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 81309 - RNA, 1410 nt, Artificial Sequence; identical to SEQ ID NO: 77746
  derived and/or modified sequence opt1 from neuraminidase__InfluenzaA__ADX96449

SEQ ID NO: 81310 - RNA, 1410 nt, Artificial Sequence; identical to SEQ ID NO: 77746
  derived and/or modified sequence opt1 from neuraminidase__InfluenzaA__ADX96469

SEQ ID NO: 81311 - RNA, 1410 nt, Artificial Sequence; identical to SEQ ID NO: 77746
  derived and/or modified sequence opt1 from neuraminidase__InfluenzaA__ADX96489

SEQ ID NO: 81312 - RNA, 1410 nt, Artificial Sequence; identical to SEQ ID NO: 77746
  derived and/or modified sequence opt1 from neuraminidase__InfluenzaA__ADX96499

SEQ ID NO: 81313 - RNA, 1410 nt, Artificial Sequence
  derived and/or modified sequence opt1 from neuraminidase__InfluenzaA__ADX96509
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaacggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81314 - RNA, 1410 nt, Artificial Sequence; identical to SEQ ID NO: 77746
  derived and/or modified sequence opt1 from neuraminidase__InfluenzaA__ADX96519

SEQ ID NO: 81315 - RNA, 1410 nt, Artificial Sequence; identical to SEQ ID NO: 77746
  derived and/or modified sequence opt1 from neuraminidase__InfluenzaA__ADX96529

SEQ ID NO: 81316 - RNA, 1410 nt, Artificial Sequence; identical to SEQ ID NO: 77746
  derived and/or modified sequence opt1 from neuraminidase__InfluenzaA__ADX96539

SEQ ID NO: 81317 - RNA, 1410 nt, Artificial Sequence; identical to SEQ ID NO: 77746
  derived and/or modified sequence opt1 from neuraminidase__InfluenzaA__ADX96549

SEQ ID NO: 81318 - RNA, 1410 nt, Artificial Sequence; identical to SEQ ID NO: 77746
  derived and/or modified sequence opt1 from neuraminidase__InfluenzaA__ADX96559

SEQ ID NO: 81319 - RNA, 1410 nt, Artificial Sequence; identical to SEQ ID NO: 77746
  derived and/or modified sequence opt1 from neuraminidase__InfluenzaA__ADX96569

SEQ ID NO: 81320 - RNA, 1410 nt, Artificial Sequence; identical to SEQ ID NO: 77736
  derived and/or modified sequence opt1 from neuraminidase__InfluenzaA__ADX96579

SEQ ID NO: 81321 - RNA, 1410 nt, Artificial Sequence; identical to SEQ ID NO: 77746
  derived and/or modified sequence opt1 from neuraminidase__InfluenzaA__ADX96589

SEQ ID NO: 81322 - RNA, 1410 nt, Artificial Sequence; identical to SEQ ID NO: 77746
  derived and/or modified sequence opt1 from neuraminidase__InfluenzaA__ADX96599

SEQ ID NO: 81323 - RNA, 1410 nt, Artificial Sequence
  derived and/or modified sequence opt1 from neuraminidase__InfluenzaA__ADX96609
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucccgguucgagagcguggccuggagcgcguccgccugccacgacggcaucaacuggcucaccaucggcaucagcgggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacggggacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 81324 - RNA, 1410 nt, Artificial Sequence; identical to SEQ ID NO: 77736
  derived and/or modified sequence opt1 from neuraminidase__InfluenzaA__ADX96619

SEQ ID NO: 81325 - RNA, 1410 nt, Artificial Sequence; identical to SEQ ID NO: 77746
  derived and/or modified sequence opt1 from neuraminidase__InfluenzaA__ADX96629

SEQ ID NO: 81326 - RNA, 1410 nt, Artificial Sequence; identical to SEQ ID NO: 77746
  derived and/or modified sequence opt1 from neuraminidase__InfluenzaA__ADX96639

SEQ ID NO: 81327 - RNA, 1410 nt, Artificial Sequence; identical to SEQ ID NO: 77746
  derived and/or modified sequence opt1 from neuraminidase__InfluenzaA__ADX96649

SEQ ID NO: 81328 - RNA, 1410 nt, Artificial Sequence; identical to SEQ ID NO: 77736
  derived and/or modified sequence opt1 from neuraminidase__InfluenzaA__ADX96659

SEQ ID NO: 81329 - RNA, 1410 nt, Artificial Sequence; identical to SEQ ID NO: 77746
  derived and/or modified sequence opt1 from neuraminidase__InfluenzaA__ADX96669

SEQ ID NO: 81330 - RNA, 1410 nt, Artificial Sequence; identical to SEQ ID NO: 77746
  derived and/or modified sequence opt1 from neuraminidase__InfluenzaA__ADX96679

SEQ ID NO: 81331 - RNA, 1410 nt, Artificial Sequence; identical to SEQ ID NO: 77746
  derived and/or modified sequence opt1 from neuraminidase__InfluenzaA__ADX96689

SEQ ID NO: 81332 - RNA, 1410 nt, Artificial Sequence; identical to SEQ ID NO: 77746
  derived and/or modified sequence opt1 from neuraminidase__InfluenzaA__ADX96699

SEQ ID NO: 81333 - RNA, 1410 nt, Artificial Sequence
  derived and/or modified sequence opt1 from neuraminidase__InfluenzaA__ADX96709
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacgagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81334 - RNA, 1410 nt, Artificial Sequence
  derived and/or modified sequence opt1 from neuraminidase__InfluenzaA__ADX96719
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagagcaccguguggaccuccgggagcuccaucagcuucugcggcgucaacuccgacaccgugggguggagcuggcccgacggcgccgagcucccguucacgaucgacaaguga

SEQ ID NO: 81335 - RNA, 1410 nt, Artificial Sequence; identical to SEQ ID NO: 77746
  derived and/or modified sequence opt1 from neuraminidase__InfluenzaA__ADX96729

SEQ ID NO: 81336 - RNA, 1410 nt, Artificial Sequence
  derived and/or modified sequence opt1 from neuraminidase__InfluenzaA__ADX96739
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaaguccgacaccgucgggugguccuggcccgacggcgccgagcugccguucacgaucgacaaguga

SEQ ID NO: 81337 - RNA, 1410 nt, Artificial Sequence; identical to SEQ ID NO: 77746
  derived and/or modified sequence opt1 from neuraminidase__InfluenzaA__ADX96749

SEQ ID NO: 81338 - RNA, 1410 nt, Artificial Sequence; identical to SEQ ID NO: 77746
  derived and/or modified sequence opt1 from neuraminidase__InfluenzaA__ADX96759

SEQ ID NO: 81339 - RNA, 1410 nt, Artificial Sequence; identical to SEQ ID NO: 78720
  derived and/or modified sequence opt1 from neuraminidase__InfluenzaA__ADX96769

SEQ ID NO: 81340 - RNA, 1410 nt, Artificial Sequence; identical to SEQ ID NO: 77746
  derived and/or modified sequence opt1 from neuraminidase__InfluenzaA__ADX96779

SEQ ID NO: 81341 - RNA, 1410 nt, Artificial Sequence
  derived and/or modified sequence opt1 from neuraminidase__InfluenzaA__ADX96789
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugucccugaagcucgccgggaacagcucccugugcccggugagcggcugggccaucuacuccaaggacaacagcauccgcaucggcuccaagggggacgucuucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgaggugcccucccccuacaacagccgguucgagagcgucgccugguccgcgagcgccugccacgacgggaucaacuggcugaccaucggcaucuccggccccgacaacggggccguggccgugcugaaguacaacggcaucaucaccgacaccaucaagagcuggcgcaacaacauccuccggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81342 - RNA, 1410 nt, Artificial Sequence; identical to SEQ ID NO: 77746
  derived and/or modified sequence opt1 from neuraminidase__InfluenzaA__ADX96799

SEQ ID NO: 81343 - RNA, 1410 nt, Artificial Sequence; identical to SEQ ID NO: 77901
  derived and/or modified sequence opt1 from neuraminidase__InfluenzaA__ADX96809

SEQ ID NO: 81344 - RNA, 1410 nt, Artificial Sequence; identical to SEQ ID NO: 77746
  derived and/or modified sequence opt1 from neuraminidase__InfluenzaA__ADX96819

SEQ ID NO: 81345 - RNA, 1410 nt, Artificial Sequence; identical to SEQ ID NO: 78969
  derived and/or modified sequence opt1 from neuraminidase__InfluenzaA__ADX96829

SEQ ID NO: 81346 - RNA, 1410 nt, Artificial Sequence
  derived and/or modified sequence opt1 from neuraminidase__InfluenzaA__ADX96839
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacaacgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucccgguucgagagcguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81347 - RNA, 1410 nt, Artificial Sequence; identical to SEQ ID NO: 77746
  derived and/or modified sequence opt1 from neuraminidase__InfluenzaA__ADX96849

SEQ ID NO: 81348 - RNA, 1410 nt, Artificial Sequence; identical to SEQ ID NO: 77746
  derived and/or modified sequence opt1 from neuraminidase__InfluenzaA__ADX96859

SEQ ID NO: 81349 - RNA, 1410 nt, Artificial Sequence; identical to SEQ ID NO: 78969
  derived and/or modified sequence opt1 from neuraminidase__InfluenzaA__ADX96869

SEQ ID NO: 81350 - RNA, 1410 nt, Artificial Sequence; identical to SEQ ID NO: 77746
  derived and/or modified sequence opt1 from neuraminidase__InfluenzaA__ADX96879

SEQ ID NO: 81351 - RNA, 1410 nt, Artificial Sequence; identical to SEQ ID NO: 77746
  derived and/or modified sequence opt1 from neuraminidase__InfluenzaA__ADX96899

SEQ ID NO: 81352 - RNA, 1410 nt, Artificial Sequence
  derived and/or modified sequence opt1 from neuraminidase__InfluenzaA__ADX96909
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacgacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81353 - RNA, 1410 nt, Artificial Sequence; identical to SEQ ID NO: 77746
  derived and/or modified sequence opt1 from neuraminidase__InfluenzaA__ADX96919

SEQ ID NO: 81354 - RNA, 1410 nt, Artificial Sequence; identical to SEQ ID NO: 77746
  derived and/or modified sequence opt1 from neuraminidase__InfluenzaA__ADX96929

SEQ ID NO: 81355 - RNA, 1410 nt, Artificial Sequence; identical to SEQ ID NO: 77746
  derived and/or modified sequence opt1 from neuraminidase__InfluenzaA__ADX96939

SEQ ID NO: 81356 - RNA, 1410 nt, Artificial Sequence; identical to SEQ ID NO: 78329
  derived and/or modified sequence opt1 from neuraminidase__InfluenzaA__ADX96949

SEQ ID NO: 81357 - RNA, 1410 nt, Artificial Sequence; identical to SEQ ID NO: 77746
  derived and/or modified sequence opt1 from neuraminidase__InfluenzaA__ADX96959

SEQ ID NO: 81358 - RNA, 1410 nt, Artificial Sequence
  derived and/or modified sequence opt1 from neuraminidase__InfluenzaA__ADX96969
augaaccccaaccagaugaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81359 - RNA, 1410 nt, Artificial Sequence; identical to SEQ ID NO: 78969
  derived and/or modified sequence opt1 from neuraminidase__InfluenzaA__ADX96979

SEQ ID NO: 81360 - RNA, 1410 nt, Artificial Sequence; identical to SEQ ID NO: 78969
  derived and/or modified sequence opt1 from neuraminidase__InfluenzaA__ADX96989

SEQ ID NO: 81361 - RNA, 1407 nt, Artificial Sequence
  derived and/or modified sequence opt1 from neuraminidase__InfluenzaA__ADX96999
augaaccccaaccagaagaucaucaccaucggcagcgugugcaugaccaucgggauggccaaccugauccuccagaucggcaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81362 - RNA, 1410 nt, Artificial Sequence; identical to SEQ ID NO: 77746
  derived and/or modified sequence opt1 from neuraminidase__InfluenzaA__ADX97009

SEQ ID NO: 81363 - RNA, 1410 nt, Artificial Sequence; identical to SEQ ID NO: 77901
  derived and/or modified sequence opt1 from neuraminidase__InfluenzaA__ADX97020

SEQ ID NO: 81364 - RNA, 1410 nt, Artificial Sequence
  derived and/or modified sequence opt1 from neuraminidase__InfluenzaA__ADX97030
augaaccccaaccagaagaucaucaccaucggcagcgugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcguggccugguccgcgagcgccugccacgacgggaucaacuggcucacgaucggcaucuccggccccgacaacggggccgucgccgugcugaaguacaacggcaucaucaccgacaccaucaagagcuggcgcaacaacauccugcggacccaggaguccgagugcgcgugcgugaacgggagcugcuucacggucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 81365 - RNA, 1410 nt, Artificial Sequence; identical to SEQ ID NO: 79294
  derived and/or modified sequence opt1 from neuraminidase__InfluenzaA__ADX98643

SEQ ID NO: 81366 - RNA, 1410 nt, Artificial Sequence; identical to SEQ ID NO: 77746
  derived and/or modified sequence opt1 from neuraminidase__InfluenzaA__ADX98653

SEQ ID NO: 81367 - RNA, 1410 nt, Artificial Sequence
  derived and/or modified sequence opt1 from neuraminidase__InfluenzaA__ADX98668
augaaccccaaccagaagaucaucaccaucggcagcaucugcaucaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81368 - RNA, 1410 nt, Artificial Sequence; identical to SEQ ID NO: 77746
  derived and/or modified sequence opt1 from neuraminidase__InfluenzaA__ADX98678

SEQ ID NO: 81369 - RNA, 1410 nt, Artificial Sequence; identical to SEQ ID NO: 77746
  derived and/or modified sequence opt1 from neuraminidase__InfluenzaA__ADX98698

SEQ ID NO: 81370 - RNA, 1410 nt, Artificial Sequence
  derived and/or modified sequence opt1 from neuraminidase__InfluenzaA__ADX98708
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 81371 - RNA, 1410 nt, Artificial Sequence; identical to SEQ ID NO: 77746
  derived and/or modified sequence opt1 from neuraminidase__InfluenzaA__ADX98722

SEQ ID NO: 81372 - RNA, 1410 nt, Artificial Sequence; identical to SEQ ID NO: 77746
  derived and/or modified sequence opt1 from neuraminidase__InfluenzaA__ADX98732

SEQ ID NO: 81373 - RNA, 1410 nt, Artificial Sequence; identical to SEQ ID NO: 77746
  derived and/or modified sequence opt1 from neuraminidase__InfluenzaA__ADX98742

SEQ ID NO: 81374 - RNA, 1410 nt, Artificial Sequence; identical to SEQ ID NO: 79097
  derived and/or modified sequence opt1 from neuraminidase__InfluenzaA__ADX98751

SEQ ID NO: 81375 - RNA, 1410 nt, Artificial Sequence; identical to SEQ ID NO: 77746
  derived and/or modified sequence opt1 from neuraminidase__InfluenzaA__ADX98761

SEQ ID NO: 81376 - RNA, 1410 nt, Artificial Sequence
  derived and/or modified sequence opt1 from neuraminidase__InfluenzaA__ADX98770
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggggagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 81377 - RNA, 1410 nt, Artificial Sequence; identical to SEQ ID NO: 77746
  derived and/or modified sequence opt1 from neuraminidase__InfluenzaA__ADX98780

SEQ ID NO: 81378 - RNA, 1410 nt, Artificial Sequence
  derived and/or modified sequence opt1 from neuraminidase__InfluenzaA__ADX98788
augaaccccaaccagaagaucaucaccaucggcagcgugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81379 - RNA, 1410 nt, Artificial Sequence
  derived and/or modified sequence opt1 from neuraminidase__InfluenzaA__ADX98809
augaaccccaaccagaagaucaucaccaucggcagcgugugcaugaccaucgggauggccaaccugauccuccagaucggcaacaucauccugaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81380 - RNA, 1410 nt, Artificial Sequence; identical to SEQ ID NO: 77746
  derived and/or modified sequence opt1 from neuraminidase__InfluenzaA__ADX98821

SEQ ID NO: 81381 - RNA, 1410 nt, Artificial Sequence; identical to SEQ ID NO: 77746
  derived and/or modified sequence opt1 from neuraminidase__InfluenzaA__ADX98846

SEQ ID NO: 81382 - RNA, 1410 nt, Artificial Sequence
  derived and/or modified sequence opt1 from neuraminidase__InfluenzaA__ADX98856
augaaccccaaccagaagaucaugaccaucggcagcgugugcaugaccaucgggauggccaaccugauccuccagaucggcaacaucaucuccaucuggaucagccacuccauccagcuggggauccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81383 - RNA, 1410 nt, Artificial Sequence; identical to SEQ ID NO: 77746
  derived and/or modified sequence opt1 from neuraminidase__InfluenzaA__ADX98863

SEQ ID NO: 81384 - RNA, 1410 nt, Artificial Sequence; identical to SEQ ID NO: 77746
  derived and/or modified sequence opt1 from neuraminidase__InfluenzaA__ADX98873

SEQ ID NO: 81385 - RNA, 1410 nt, Artificial Sequence
  derived and/or modified sequence opt1 from neuraminidase__InfluenzaA__ADX98883
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacgucgccgcgggccagagcgugguguccgucaagcuggccgggaacagcucccucugcccggugagcggcugggccaucuacuccaaggacaacagcauccgcaucggcuccaagggggacgccuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 81386 - RNA, 1410 nt, Artificial Sequence; identical to SEQ ID NO: 77746
  derived and/or modified sequence opt1 from neuraminidase__InfluenzaA__ADX98893

SEQ ID NO: 81387 - RNA, 1410 nt, Artificial Sequence; identical to SEQ ID NO: 77746
  derived and/or modified sequence opt1 from neuraminidase__InfluenzaA__ADX98903

SEQ ID NO: 81388 - RNA, 1410 nt, Artificial Sequence; identical to SEQ ID NO: 79299
  derived and/or modified sequence opt1 from neuraminidase__InfluenzaA__ADX98913

SEQ ID NO: 81389 - RNA, 1410 nt, Artificial Sequence; identical to SEQ ID NO: 79177
  derived and/or modified sequence opt1 from neuraminidase__InfluenzaA__ADX98923

SEQ ID NO: 81390 - RNA, 1410 nt, Artificial Sequence; identical to SEQ ID NO: 79183
  derived and/or modified sequence opt1 from neuraminidase__InfluenzaA__ADX98933

SEQ ID NO: 81391 - RNA, 1410 nt, Artificial Sequence; identical to SEQ ID NO: 77746
  derived and/or modified sequence opt1 from neuraminidase__InfluenzaA__ADX98943

SEQ ID NO: 81392 - RNA, 1410 nt, Artificial Sequence; identical to SEQ ID NO: 79703
  derived and/or modified sequence opt1 from neuraminidase__InfluenzaA__ADX98953

SEQ ID NO: 81393 - RNA, 1410 nt, Artificial Sequence; identical to SEQ ID NO: 77746
  derived and/or modified sequence opt1 from neuraminidase__InfluenzaA__ADX98963

SEQ ID NO: 81394 - RNA, 1410 nt, Artificial Sequence
  derived and/or modified sequence opt1 from neuraminidase__InfluenzaA__ADX98973
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugaucugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81395 - RNA, 1410 nt, Artificial Sequence; identical to SEQ ID NO: 77746
  derived and/or modified sequence opt1 from neuraminidase__InfluenzaA__ADX98983

SEQ ID NO: 81396 - RNA, 1410 nt, Artificial Sequence; identical to SEQ ID NO: 77746
  derived and/or modified sequence opt1 from neuraminidase__InfluenzaA__ADX98993

SEQ ID NO: 81397 - RNA, 1410 nt, Artificial Sequence; identical to SEQ ID NO: 77746
  derived and/or modified sequence opt1 from neuraminidase__InfluenzaA__ADX99003

SEQ ID NO: 81398 - RNA, 1365 nt, Artificial Sequence
  derived and/or modified sequence opt1 from neuraminidase__InfluenzaA__ADX99584
augaaccccaaccagaagaucaccaccaucggcagcaucugccugguggucgggcucaucucccugauccugcagaucggcaacaucaucagcaucuggaucucccacagcauccagacggggucccagaaccacaccggcaucugcaaccagaacaucaucaccuacaagaacagcaccugggugaaggacacgaccuccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacgcagggcgcccugcugaacgacaagcacuccaacgggaccgugaaggaccgcagccccuaccgggcgcucauguccugccccgucggcgaggccccgagccccuacaacucccgcuucgagagcguggccuggagcgccuccgccugccacgacgggaugggcuggcugaccaucggcaucagcgggcccgacaacggcgcgguggccguccugaaguacaacgggaucaucaccgagacgaucaaguccuggcggaagaagauccuccgcacccaggagagcgagugcgccugcgugaacggcuccugcuucaccaucaugaccgacggccccagcgacgggcuggccuccuacaagaucuucaagaucgagaagggcaaggugaccaagagcaucgagcugaacgcgccgaacucccacuacgaggagugcagcugcuaccccgacacggggaaggucaugugcgugugccgggacaacuggcacggcuccaaccgccccugggugagcuucgaccagaaccucgacuaccagaucggguacaucugcuccggcgucuucggcgacaacccccggccggaggacgggaccggcagcugcgggcccguguacguggacggcgccaacggggucaagggcuucuccuaccgcuacggcaacgggguguggaucggccggaccaagagccacuccagccgccacggguucgagaugaucugggaccccaacggcuggacggagaccgacuccaaguucagcgugcggcaggacgucguggccaugaccgacuggagcggguacuccggcagcuucgugcagcaccccgagcugaccggccuggacugcaugcgcccgugcuucugggucgagcucauccgggggcgccccaaggagaagacgaucuggaccuccgccagcuccaucagcuucugcggcgugaacuccgacaccgucgacuggagcuggcccgacggggccgagcugcccuucuccaucgacaaguga

SEQ ID NO: 81399 - RNA, 1365 nt, Artificial Sequence; identical to SEQ ID NO: 81398
  derived and/or modified sequence opt1 from neuraminidase__InfluenzaA__ADX99595

SEQ ID NO: 81400 - RNA, 1365 nt, Artificial Sequence; identical to SEQ ID NO: 81398
  derived and/or modified sequence opt1 from neuraminidase__InfluenzaA__ADX99606

SEQ ID NO: 81401 - RNA, 1365 nt, Artificial Sequence; identical to SEQ ID NO: 81398
  derived and/or modified sequence opt1 from neuraminidase__InfluenzaA__ADX99617

SEQ ID NO: 81402 - RNA, 1365 nt, Artificial Sequence; identical to SEQ ID NO: 81398
  derived and/or modified sequence opt1 from neuraminidase__InfluenzaA__ADX99628

SEQ ID NO: 81403 - RNA, 1365 nt, Artificial Sequence; identical to SEQ ID NO: 81398
  derived and/or modified sequence opt1 from neuraminidase__InfluenzaA__ADX99639

SEQ ID NO: 81404 - RNA, 1365 nt, Artificial Sequence; identical to SEQ ID NO: 76727
  derived and/or modified sequence opt1 from neuraminidase__InfluenzaA__ADX99650

SEQ ID NO: 81405 - RNA, 1365 nt, Artificial Sequence; identical to SEQ ID NO: 76727
  derived and/or modified sequence opt1 from neuraminidase__InfluenzaA__ADX99672

SEQ ID NO: 81406 - RNA, 1365 nt, Artificial Sequence; identical to SEQ ID NO: 76727
  derived and/or modified sequence opt1 from neuraminidase__InfluenzaA__ADX99683

SEQ ID NO: 81407 - RNA, 1365 nt, Artificial Sequence; identical to SEQ ID NO: 76727
  derived and/or modified sequence opt1 from neuraminidase__InfluenzaA__ADX99694

SEQ ID NO: 81408 - RNA, 1365 nt, Artificial Sequence; identical to SEQ ID NO: 76727
  derived and/or modified sequence opt1 from neuraminidase__InfluenzaA__ADX99705

SEQ ID NO: 81409 - RNA, 1365 nt, Artificial Sequence; identical to SEQ ID NO: 76727
  derived and/or modified sequence opt1 from neuraminidase__InfluenzaA__ADX99846

SEQ ID NO: 81410 - RNA, 1365 nt, Artificial Sequence; identical to SEQ ID NO: 76727
  derived and/or modified sequence opt1 from neuraminidase__InfluenzaA__ADX99857

SEQ ID NO: 81411 - RNA, 1365 nt, Artificial Sequence; identical to SEQ ID NO: 76727
  derived and/or modified sequence opt1 from neuraminidase__InfluenzaA__ADX99868

SEQ ID NO: 81412 - RNA, 1365 nt, Artificial Sequence; identical to SEQ ID NO: 76727
  derived and/or modified sequence opt1 from neuraminidase__InfluenzaA__ADX99879

SEQ ID NO: 81413 - RNA, 1365 nt, Artificial Sequence; identical to SEQ ID NO: 76727
  derived and/or modified sequence opt1 from neuraminidase__InfluenzaA__ADX99890

SEQ ID NO: 81414 - RNA, 1365 nt, Artificial Sequence; identical to SEQ ID NO: 76727
  derived and/or modified sequence opt1 from neuraminidase__InfluenzaA__ADX99901

SEQ ID NO: 81415 - RNA, 1365 nt, Artificial Sequence
  derived and/or modified sequence opt1 from neuraminidase__InfluenzaA__ADX99912
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucaucauccgcgagcccuucaucuccugcagccaccuggagugccggaccuucuuccucacccagggcgcccugcugaacgacaagcacuccagcgggacggugaaggaccgcucccccuaccgggcgcucaugagcugccccgugggcgaggccccgucccccuacaacagccgcuucgagagcgucgccugguccgccagcgccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggugaugugcgucugccgggacaacuggcacggcagcaaccgccccuggguguccuucgaccagaaccucgacuaccagaucggguacaucugcagcggcguguucggcgacaacccccggccggaggacgggaccggcuccugcgggcccgucuacguggacggcgccaacggggugaagggcuucagcuaccgcuacggcaacggggucuggaucggccggaccaagucccacagcucccgccacggguucgagaugaucugggaccccaacggcuggaccgagacggacagcaaguucagcgugcggcaggacguggucgccaugaccgacugguccggguacagcggcuccuucgugcagcaccccgagcugaccggccuggacugcaugcgcccgugcuucuggguggagcucauccgggggcgccccaaggagaagaccaucuggacgagcgccuccagcaucuccuucugcggcgucaacagcgacaccguggacugguccuggcccgacggggccgagcugcccuucagcaucgacaaguga

SEQ ID NO: 81416 - RNA, 1365 nt, Artificial Sequence; identical to SEQ ID NO: 76727
  derived and/or modified sequence opt1 from neuraminidase__InfluenzaA__ADX99923

SEQ ID NO: 81417 - RNA, 1365 nt, Artificial Sequence; identical to SEQ ID NO: 76727
  derived and/or modified sequence opt1 from neuraminidase__InfluenzaA__ADX99934

SEQ ID NO: 81418 - RNA, 1365 nt, Artificial Sequence; identical to SEQ ID NO: 76727
  derived and/or modified sequence opt1 from neuraminidase__InfluenzaA__ADX99956

SEQ ID NO: 81419 - RNA, 1365 nt, Artificial Sequence; identical to SEQ ID NO: 76727
  derived and/or modified sequence opt1 from neuraminidase__InfluenzaA__ADX99967

SEQ ID NO: 81420 - RNA, 1365 nt, Artificial Sequence; identical to SEQ ID NO: 76727
  derived and/or modified sequence opt1 from neuraminidase__InfluenzaA__ADX99978

SEQ ID NO: 81421 - RNA, 1365 nt, Artificial Sequence; identical to SEQ ID NO: 76727
  derived and/or modified sequence opt1 from neuraminidase__InfluenzaA__ADX99989

SEQ ID NO: 81422 - RNA, 1365 nt, Artificial Sequence; identical to SEQ ID NO: 76727
  derived and/or modified sequence opt1 from neuraminidase__InfluenzaA__ADY00001

SEQ ID NO: 81423 - RNA, 1365 nt, Artificial Sequence; identical to SEQ ID NO: 76727
  derived and/or modified sequence opt1 from neuraminidase__InfluenzaA__ADY00012

SEQ ID NO: 81424 - RNA, 1365 nt, Artificial Sequence; identical to SEQ ID NO: 76727
  derived and/or modified sequence opt1 from neuraminidase__InfluenzaA__ADY00023

SEQ ID NO: 81425 - RNA, 1413 nt, Artificial Sequence
  derived and/or modified sequence opt1 from neuraminidase__InfluenzaA__ADY04729
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucaccauggccggcaacuccagccugugcuccaucagcggcugggccaucuacaccaaggacaacuccauccggaucgggagcaagggcgacguguucgugauccgcgagccguucaucuccugcagccaccuggagugccggacguucuuccucacccagggggcccugcugaacgacaagcacuccaacggcaccgucaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcgguggccguccucaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgggacaacuggcacgggagcaaccgccccugggucuccuucaaccagaaccucgacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcugaccggccucgacugcauccggcccugcuucuggguggagcugguccgcgggcugccgaaggagaacaccaccaucuggacgagcggcuccagcaucuccuucugcggggugaacagcgacaccgccaacugguccuggcccgacggcgccgagcuccccuucaccaucgacaaguga

SEQ ID NO: 81426 - RNA, 1410 nt, Artificial Sequence; identical to SEQ ID NO: 80526
  derived and/or modified sequence opt1 from neuraminidase__InfluenzaA__ADY11828

SEQ ID NO: 81427 - RNA, 1410 nt, Artificial Sequence; identical to SEQ ID NO: 77607
  derived and/or modified sequence opt1 from neuraminidase__InfluenzaA__ADY11839

SEQ ID NO: 81428 - RNA, 1410 nt, Artificial Sequence; identical to SEQ ID NO: 77607
  derived and/or modified sequence opt1 from neuraminidase__InfluenzaA__ADY17657

SEQ ID NO: 81429 - RNA, 1410 nt, Artificial Sequence; identical to SEQ ID NO: 77607
  derived and/or modified sequence opt1 from neuraminidase__InfluenzaA__ADY17668

SEQ ID NO: 81430 - RNA, 1410 nt, Artificial Sequence; identical to SEQ ID NO: 77607
  derived and/or modified sequence opt1 from neuraminidase__InfluenzaA__ADY17679

SEQ ID NO: 81431 - RNA, 1410 nt, Artificial Sequence; identical to SEQ ID NO: 77607
  derived and/or modified sequence opt1 from neuraminidase__InfluenzaA__ADY17690

SEQ ID NO: 81432 - RNA, 1410 nt, Artificial Sequence; identical to SEQ ID NO: 77607
  derived and/or modified sequence opt1 from neuraminidase__InfluenzaA__ADY17701

SEQ ID NO: 81433 - RNA, 1410 nt, Artificial Sequence; identical to SEQ ID NO: 77746
  derived and/or modified sequence opt1 from neuraminidase__InfluenzaA__ADY38722

SEQ ID NO: 81434 - RNA, 1410 nt, Artificial Sequence; identical to SEQ ID NO: 79495
  derived and/or modified sequence opt1 from neuraminidase__InfluenzaA__ADY38723

SEQ ID NO: 81435 - RNA, 1410 nt, Artificial Sequence; identical to SEQ ID NO: 77746
  derived and/or modified sequence opt1 from neuraminidase__InfluenzaA__ADY38734

SEQ ID NO: 81436 - RNA, 1410 nt, Artificial Sequence; identical to SEQ ID NO: 79338
  derived and/or modified sequence opt1 from neuraminidase__InfluenzaA__ADY38753

SEQ ID NO: 81437 - RNA, 1410 nt, Artificial Sequence; identical to SEQ ID NO: 77746
  derived and/or modified sequence opt1 from neuraminidase__InfluenzaA__ADY38763

SEQ ID NO: 81438 - RNA, 1410 nt, Artificial Sequence; identical to SEQ ID NO: 77746
  derived and/or modified sequence opt1 from neuraminidase__InfluenzaA__ADZ04600

SEQ ID NO: 81439 - RNA, 1410 nt, Artificial Sequence; identical to SEQ ID NO: 77746
  derived and/or modified sequence opt1 from neuraminidase__InfluenzaA__ADZ04610

SEQ ID NO: 81440 - RNA, 1410 nt, Artificial Sequence; identical to SEQ ID NO: 77746
  derived and/or modified sequence opt1 from neuraminidase__InfluenzaA__ADZ04693

SEQ ID NO: 81441 - RNA, 1410 nt, Artificial Sequence; identical to SEQ ID NO: 77746
  derived and/or modified sequence opt1 from neuraminidase__InfluenzaA__ADZ04701

SEQ ID NO: 81442 - RNA, 1410 nt, Artificial Sequence; identical to SEQ ID NO: 77746
  derived and/or modified sequence opt1 from neuraminidase__InfluenzaA__ADZ04711

SEQ ID NO: 81443 - RNA, 1410 nt, Artificial Sequence
  derived and/or modified sequence opt1 from neuraminidase__InfluenzaA__ADZ05393
augaaccccaaccagaagaucaucaccaucgacagcgugugcaugaccaucggcauggccaaccugauccuccagaucgggaacaucaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcgugcgcaucggcuccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacgggccguccaacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 81444 - RNA, 1413 nt, Artificial Sequence
  derived and/or modified sequence opt1 from neuraminidase__InfluenzaA__ADZ05837
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucacgugcgagaacuccaccugggugaaccacaccuacgucaacaucaacaacaccaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaccacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 81445 - RNA, 1413 nt, Artificial Sequence; identical to SEQ ID NO: 78469
  derived and/or modified sequence opt1 from neuraminidase__InfluenzaA__ADZ05848

SEQ ID NO: 81446 - RNA, 1410 nt, Artificial Sequence; identical to SEQ ID NO: 78913
  derived and/or modified sequence opt1 from neuraminidase__InfluenzaA__ADZ05858

SEQ ID NO: 81447 - RNA, 1410 nt, Artificial Sequence; identical to SEQ ID NO: 77746
  derived and/or modified sequence opt1 from neuraminidase__InfluenzaA__ADZ47841

SEQ ID NO: 81448 - RNA, 1410 nt, Artificial Sequence; identical to SEQ ID NO: 77746
  derived and/or modified sequence opt1 from neuraminidase__InfluenzaA__ADZ47851

SEQ ID NO: 81449 - RNA, 1410 nt, Artificial Sequence
  derived and/or modified sequence opt1 from neuraminidase__InfluenzaA__ADZ47861
augaaccccaaccagaagaucaucaccaucggcagcgugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaucaacuucgccgcgggccagagcgucguguccgugaagcucgccgggaacagcucccugugcccggucagcggcugggccaucuacuccaaggacaacagcgugcgcaucggcuccaagggggacguguucgucauccgggagcccuucaucagcugcagcccccuggagugccgcacguucuuccucacccagggcgcccugcugaacgacaagcacuccaacgggaccaucaaggaccggucccccuaccgcacccucaugagcugcccgaucggcgaggugcccucccccuacaacagccgguucgagagcguggccugguccgcgagcgccugccacgacgggaucaacuggcugacgaucggcaucuccggccccgacaacggggccgucgccgugcugaaguacaacggcaucaucaccgacaccaucaagagcuggcgcaacaacauccuccggacccaggaguccgagugcgcgugcgugaacgggagcugcuucacggucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaagaacuucagcaucaagcaggacaucguggggaucaacgagugguccggcuacagcggguccuucguccagcacccggagcugaccggccucgacugcauccggcccugcuucuggguggagcugauccgcggccggcccaaggagaacacgaucuggaccagcggguccagcaucuccuucugcggcgucaacagcgacaccguggggugguccuggcccgacggcgccgagcugccguucaccaucgacaaguga

SEQ ID NO: 81450 - RNA, 1413 nt, Artificial Sequence
  derived and/or modified sequence opt1 from neuraminidase__InfluenzaA__ADZ53101
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaaggugguggcgggggaggacaagaccagcgucacccuggccggcaacuccagccugugcuccaucagcggcugggccaucaacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81451 - RNA, 1410 nt, Artificial Sequence
  derived and/or modified sequence opt1 from neuraminidase__InfluenzaA__ADZ53124
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacgacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81452 - RNA, 1410 nt, Artificial Sequence; identical to SEQ ID NO: 77746
  derived and/or modified sequence opt1 from neuraminidase__InfluenzaA__ADZ53130

SEQ ID NO: 81453 - RNA, 1410 nt, Artificial Sequence; identical to SEQ ID NO: 77736
  derived and/or modified sequence opt1 from neuraminidase__InfluenzaA__ADZ53132

SEQ ID NO: 81454 - RNA, 1410 nt, Artificial Sequence; identical to SEQ ID NO: 77746
  derived and/or modified sequence opt1 from neuraminidase__InfluenzaA__ADZ53134

SEQ ID NO: 81455 - RNA, 1410 nt, Artificial Sequence; identical to SEQ ID NO: 77746
  derived and/or modified sequence opt1 from neuraminidase__InfluenzaA__ADZ53136

SEQ ID NO: 81456 - RNA, 1410 nt, Artificial Sequence; identical to SEQ ID NO: 78100
  derived and/or modified sequence opt1 from neuraminidase__InfluenzaA__ADZ53137

SEQ ID NO: 81457 - RNA, 1410 nt, Artificial Sequence; identical to SEQ ID NO: 77746
  derived and/or modified sequence opt1 from neuraminidase__InfluenzaA__ADZ53139

SEQ ID NO: 81458 - RNA, 1410 nt, Artificial Sequence
  derived and/or modified sequence opt1 from neuraminidase__InfluenzaA__ADZ53141
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacgacuucagcaucaagcaggacaucguggggaucaacgagugguccggcuacagcggguccuucgugcagcacagcgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 81459 - RNA, 1410 nt, Artificial Sequence; identical to SEQ ID NO: 77607
  derived and/or modified sequence opt1 from neuraminidase__InfluenzaA__AEA03712

SEQ ID NO: 81460 - RNA, 1410 nt, Artificial Sequence; identical to SEQ ID NO: 77607
  derived and/or modified sequence opt1 from neuraminidase__InfluenzaA__AEA03722

SEQ ID NO: 81461 - RNA, 1410 nt, Artificial Sequence; identical to SEQ ID NO: 77607
  derived and/or modified sequence opt1 from neuraminidase__InfluenzaA__AEA03744

SEQ ID NO: 81462 - RNA, 1410 nt, Artificial Sequence
  derived and/or modified sequence opt1 from neuraminidase__InfluenzaA__AEA03755
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 81463 - RNA, 1410 nt, Artificial Sequence; identical to SEQ ID NO: 77607
  derived and/or modified sequence opt1 from neuraminidase__InfluenzaA__AEA03766

SEQ ID NO: 81464 - RNA, 1410 nt, Artificial Sequence; identical to SEQ ID NO: 77607
  derived and/or modified sequence opt1 from neuraminidase__InfluenzaA__AEA03796

SEQ ID NO: 81465 - RNA, 1410 nt, Artificial Sequence; identical to SEQ ID NO: 77607
  derived and/or modified sequence opt1 from neuraminidase__InfluenzaA__AEA03806

SEQ ID NO: 81466 - RNA, 1410 nt, Artificial Sequence
  derived and/or modified sequence opt1 from neuraminidase__InfluenzaA__AEA03817
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgaccgcugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81467 - RNA, 1410 nt, Artificial Sequence; identical to SEQ ID NO: 77607
  derived and/or modified sequence opt1 from neuraminidase__InfluenzaA__AEA03828

SEQ ID NO: 81468 - RNA, 1410 nt, Artificial Sequence; identical to SEQ ID NO: 77607
  derived and/or modified sequence opt1 from neuraminidase__InfluenzaA__AEA03838

SEQ ID NO: 81469 - RNA, 1410 nt, Artificial Sequence; identical to SEQ ID NO: 80763
  derived and/or modified sequence opt1 from neuraminidase__InfluenzaA__AEA03849

SEQ ID NO: 81470 - RNA, 1410 nt, Artificial Sequence; identical to SEQ ID NO: 77607
  derived and/or modified sequence opt1 from neuraminidase__InfluenzaA__AEA03860

SEQ ID NO: 81471 - RNA, 1410 nt, Artificial Sequence
  derived and/or modified sequence opt1 from neuraminidase__InfluenzaA__AEA03871
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaucaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81472 - RNA, 1410 nt, Artificial Sequence; identical to SEQ ID NO: 77607
  derived and/or modified sequence opt1 from neuraminidase__InfluenzaA__AEA03879

SEQ ID NO: 81473 - RNA, 1410 nt, Artificial Sequence
  derived and/or modified sequence opt1 from neuraminidase__InfluenzaA__AEA03889
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 81474 - RNA, 1410 nt, Artificial Sequence
  derived and/or modified sequence opt1 from neuraminidase__InfluenzaA__AEA03898
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaaguccgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 81475 - RNA, 1410 nt, Artificial Sequence; identical to SEQ ID NO: 77607
  derived and/or modified sequence opt1 from neuraminidase__InfluenzaA__AEA03909

SEQ ID NO: 81476 - RNA, 1410 nt, Artificial Sequence
  derived and/or modified sequence opt1 from neuraminidase__InfluenzaA__AEA03924
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 81477 - RNA, 1410 nt, Artificial Sequence; identical to SEQ ID NO: 77607
  derived and/or modified sequence opt1 from neuraminidase__InfluenzaA__AEA03935

SEQ ID NO: 81478 - RNA, 1410 nt, Artificial Sequence
  derived and/or modified sequence opt1 from neuraminidase__InfluenzaA__AEA03946
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccgaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81479 - RNA, 1410 nt, Artificial Sequence
  derived and/or modified sequence opt1 from neuraminidase__InfluenzaA__AEA03957
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaacuccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 81480 - RNA, 1410 nt, Artificial Sequence; identical to SEQ ID NO: 77607
  derived and/or modified sequence opt1 from neuraminidase__InfluenzaA__AEA03989

SEQ ID NO: 81481 - RNA, 1410 nt, Artificial Sequence; identical to SEQ ID NO: 80763
  derived and/or modified sequence opt1 from neuraminidase__InfluenzaA__AEA04000

SEQ ID NO: 81482 - RNA, 1410 nt, Artificial Sequence; identical to SEQ ID NO: 77607
  derived and/or modified sequence opt1 from neuraminidase__InfluenzaA__AEA04011

SEQ ID NO: 81483 - RNA, 1410 nt, Artificial Sequence; identical to SEQ ID NO: 80763
  derived and/or modified sequence opt1 from neuraminidase__InfluenzaA__AEA04022

SEQ ID NO: 81484 - RNA, 1410 nt, Artificial Sequence; identical to SEQ ID NO: 77607
  derived and/or modified sequence opt1 from neuraminidase__InfluenzaA__AEA04033

SEQ ID NO: 81485 - RNA, 1410 nt, Artificial Sequence; identical to SEQ ID NO: 77607
  derived and/or modified sequence opt1 from neuraminidase__InfluenzaA__AEA04044

SEQ ID NO: 81486 - RNA, 1410 nt, Artificial Sequence; identical to SEQ ID NO: 77607
  derived and/or modified sequence opt1 from neuraminidase__InfluenzaA__AEA04049

SEQ ID NO: 81487 - RNA, 1410 nt, Artificial Sequence; identical to SEQ ID NO: 77607
  derived and/or modified sequence opt1 from neuraminidase__InfluenzaA__AEA04059

SEQ ID NO: 81488 - RNA, 1410 nt, Artificial Sequence; identical to SEQ ID NO: 77607
  derived and/or modified sequence opt1 from neuraminidase__InfluenzaA__AEA04070

SEQ ID NO: 81489 - RNA, 1410 nt, Artificial Sequence; identical to SEQ ID NO: 80763
  derived and/or modified sequence opt1 from neuraminidase__InfluenzaA__AEA04081

SEQ ID NO: 81490 - RNA, 1410 nt, Artificial Sequence; identical to SEQ ID NO: 77607
  derived and/or modified sequence opt1 from neuraminidase__InfluenzaA__AEA04092

SEQ ID NO: 81491 - RNA, 1410 nt, Artificial Sequence; identical to SEQ ID NO: 77607
  derived and/or modified sequence opt1 from neuraminidase__InfluenzaA__AEA04103

SEQ ID NO: 81492 - RNA, 1410 nt, Artificial Sequence; identical to SEQ ID NO: 77607
  derived and/or modified sequence opt1 from neuraminidase__InfluenzaA__AEA04125

SEQ ID NO: 81493 - RNA, 1410 nt, Artificial Sequence; identical to SEQ ID NO: 77607
  derived and/or modified sequence opt1 from neuraminidase__InfluenzaA__AEA04133

SEQ ID NO: 81494 - RNA, 1410 nt, Artificial Sequence
  derived and/or modified sequence opt1 from neuraminidase__InfluenzaA__AEA04144
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucaucguguucugcggcaccuccgggacguacggcaccgggagcuggccggacggcgccgacaucaaccugaugcccaucuga

SEQ ID NO: 81495 - RNA, 1410 nt, Artificial Sequence; identical to SEQ ID NO: 77607
  derived and/or modified sequence opt1 from neuraminidase__InfluenzaA__AEA04155

SEQ ID NO: 81496 - RNA, 1410 nt, Artificial Sequence; identical to SEQ ID NO: 77607
  derived and/or modified sequence opt1 from neuraminidase__InfluenzaA__AEA04166

SEQ ID NO: 81497 - RNA, 1410 nt, Artificial Sequence
  derived and/or modified sequence opt1 from neuraminidase__InfluenzaA__AEA04177
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81498 - RNA, 1410 nt, Artificial Sequence; identical to SEQ ID NO: 77607
  derived and/or modified sequence opt1 from neuraminidase__InfluenzaA__AEA04188

SEQ ID NO: 81499 - RNA, 1410 nt, Artificial Sequence; identical to SEQ ID NO: 78600
  derived and/or modified sequence opt1 from neuraminidase__InfluenzaA__AEA04199

SEQ ID NO: 81500 - RNA, 1410 nt, Artificial Sequence; identical to SEQ ID NO: 77607
  derived and/or modified sequence opt1 from neuraminidase__InfluenzaA__AEA04210

SEQ ID NO: 81501 - RNA, 1410 nt, Artificial Sequence; identical to SEQ ID NO: 78600
  derived and/or modified sequence opt1 from neuraminidase__InfluenzaA__AEA04229

SEQ ID NO: 81502 - RNA, 1410 nt, Artificial Sequence; identical to SEQ ID NO: 78600
  derived and/or modified sequence opt1 from neuraminidase__InfluenzaA__AEA04239

SEQ ID NO: 81503 - RNA, 1410 nt, Artificial Sequence
  derived and/or modified sequence opt1 from neuraminidase__InfluenzaA__AEA04250
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgugcggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacgcaggagagcgagugcgugugcaucaacgggaccugcaccgucgugaugaccgacggguccgccagcggcaaggccgacacgaagauccucuucaucgaggagggcaagaucgugcacaccagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcacguccgggaccuacggcaccgggagcuggccggacggcgccgacaucaaccugaugcccaucuga

SEQ ID NO: 81504 - RNA, 1410 nt, Artificial Sequence; identical to SEQ ID NO: 78600
  derived and/or modified sequence opt1 from neuraminidase__InfluenzaA__AEA04260

SEQ ID NO: 81505 - RNA, 1410 nt, Artificial Sequence
  derived and/or modified sequence opt1 from neuraminidase__InfluenzaA__AEA04268
augaaccccaaccagaagaucaucaccaucggcagcgugucccugaccaucagcacgaucugccucuucaugcagaccgccauccugaucaccaccgucacgcugcacuucaagcagugcgaguucaacuccccgcccaacaaccaggccaugcucugcgagcccaccaucaucgagcgcaacaucaccgagaucguguaccugaccaacacgaccaucgagaaggagaucugccccaagcuggcggaguaccggaacuggagcaagccgcagugcgacaucaccggguucgcccccuucuccaaggacaacagcauccgccucuccgccggcggggacaucugggugacccgggagcccuacgucagcugcgaccccgacaagugcuaccaguucgcccugggccaggggacgacccugaacaacgugcacuccaacaacaccgugcgcgaccggaccccguaccgcacgcuccugaugaacgagcugggcguccccuuccaccucggcaccaagcaggucugcaucgccuggagcuccagcuccugccacgacgggaaggcguggcugcacgugugcaucaccggcgacgacaagaacgccaccgccagcuucaucuacaacgggcggcugguggacuccguggugagcugguccaaggagauccuccgcacgcaggagagcgagugcgucugcaucaacgggaccugcaccguggugaugaccgacggguccgccagcggcaaggcggacacgaagauccuguucaucgaggagggcaagaucguccacaccagcacccuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccucgugggcgacacgccccggaagaacgacuccagcuccagcucccacugccuggaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcacguccgggaccuacggcaccgggagcuggccggacggcgccgacaucaaccucaugcccaucuga

SEQ ID NO: 81506 - RNA, 1410 nt, Artificial Sequence; identical to SEQ ID NO: 78600
  derived and/or modified sequence opt1 from neuraminidase__InfluenzaA__AEA04276

SEQ ID NO: 81507 - RNA, 1410 nt, Artificial Sequence; identical to SEQ ID NO: 78600
  derived and/or modified sequence opt1 from neuraminidase__InfluenzaA__AEA04287

SEQ ID NO: 81508 - RNA, 1410 nt, Artificial Sequence; identical to SEQ ID NO: 78600
  derived and/or modified sequence opt1 from neuraminidase__InfluenzaA__AEA04298

SEQ ID NO: 81509 - RNA, 1410 nt, Artificial Sequence
  derived and/or modified sequence opt1 from neuraminidase__InfluenzaA__AEA04307
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggcuccgccagcggcaaggccgacacgaagauccucuucaucgaggagggcaagaucgugcacaccagcacccuguccgggagcgcgcagcacguggaggagugcuccugcuacccccgguaccccgacguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucagcgagaagucccggcugggcuacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcacguccggcaccuacgggaccggcagcuggccggacggggccgacaucaaccugaugcccaucuga

SEQ ID NO: 81510 - RNA, 1395 nt, Artificial Sequence
  derived and/or modified sequence opt1 from neuraminidase__InfluenzaA__AEA04357
augaaccccaaccagaagaucaucaccaucggcagcaucugcaugguggucgggaucaucucccugauccuccagaucggcaacaucgugagcaucuggaucucccacagcauccagaccgggaaccagaaccacacggggaccugcgaccaguccaucaucaccuacaagaacagcaccugggugaaccagacguacgucaacgugguggccggcaaggacaccaccuccgucauccuggccggcaacagcucccugugcccgauccgcggcugggcgaucuacagcaaggacaacggggugcggaucggcuccaagggggacguguucgucauccgcgagcccuucaucagcugcucccaccucgagugccggaccuucuuccugacgcagggcgcccugcucaacgacaagcacagcaacgggaccgugaaggaccgcucccccuaccgggcccugaugagcugccccgugggcgaggccccgucccccuacaacagccgcuucgaguccgucgccuggagcgcgagcgccugccacgacggcaugggguggcugaccaucggcaucuccgggcccgacgacggcgccguggccgugcucaaguacaacggcaucaucaccgagacgaucaagagcuggcggaaggagauccugcgcacccaggaguccgagugcgucugcgugaacgggagcugcuucaccaucaugaccgacggccccuccgggggcccggcgagcuacaagaucuucaagaucgagaaggggaaggugacgaaguccaucgagcuggacgcccccaacagccacuacgaggagugcuccugcuaccccgacaccagcaaggucaugugcgugugccgggacaacuggcacggcuccaaccgccccugggugagcuucgaccagaaccucgacuaccagaugggcuacaucugcuccggggucuucggcgacaacccgcggcccaaggacgggaagggcagcugcgggcccguguacguggacggcgccaacggcgucaagggguucuccuacaaguacggcaacgggguguggaucggccgcaccaagagcaucuccagccggcagggguucgagaugaucugggaccccaacggcuggaccgagacggacuccaacuucuucaccaagcaggacgucguggccgugaccgacuggagcggcuacagcggguccuucguccagcacccggagcugaccggccuggacugcaugcgccccugcuucuggguggagcucauccgggggcgccccaaggagaacacgaucuggaccagcggcuccagcaucuccuucugcggcgugaacagcgacaccgucgacugguccuggcccgacggggccgagcugccguucaccaucgacaaguga

SEQ ID NO: 81511 - RNA, 1410 nt, Artificial Sequence; identical to SEQ ID NO: 77475
  derived and/or modified sequence opt1 from neuraminidase__InfluenzaA__AEA04368

SEQ ID NO: 81512 - RNA, 1410 nt, Artificial Sequence
  derived and/or modified sequence opt1 from neuraminidase__InfluenzaA__AEA04379
augaaccccaaccagaagaccaucaccaucggcagcgugucccugacgaucgagaccgucugcuuccucaugcagaucgccauccuggccaccaccgugacgcugcacuucaagcagcacgagugcgacagcccggcguccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacagcauccgccuguccgccggcggggacaucugggucacccgggagcccuacgugagcugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggagcuccagcuccugccacgacgggaaggcguggcugcacgugugcgucaccggcgacgaccgcaacgccacggccagcuucaucuacgacgggcggcucguggacuccaucggcagcuggucccagaacauccugcgcacccaggagagcgagugcgugugcaucaacgggaccugcaccgucgugaugacggacggcuccgccagcggccgggcggacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaagucccgcgaccccaacaacgagcgggggaacccgggcgugaaggggugggccuucgacaacggcgacgacguguggaugggccgcaccaucagcaaggacucccggagcggguacgagaccuucaaggucaucggcgggugguccacccccaacagcaagucccaggugaaccgccaggucaucguggacaacaacaacuggagcggcuacagcgggaucuucuccguggagggcaagagcugcaucaaccggugcuucuacgucgagcugauccgcggccgcccccaggagacccgggugugguggaccuccaacagcaucguggucuucugcgggacguccggcaccuacgggaccggcagcuggcccgacggggccaacaucaacuucaugccgaucuga

SEQ ID NO: 81513 - RNA, 1413 nt, Artificial Sequence; identical to SEQ ID NO: 81212
  derived and/or modified sequence opt1 from neuraminidase__InfluenzaA__AEA10295

SEQ ID NO: 81514 - RNA, 1410 nt, Artificial Sequence; identical to SEQ ID NO: 77746
  derived and/or modified sequence opt1 from neuraminidase__InfluenzaA__AEA10306

SEQ ID NO: 81515 - RNA, 1410 nt, Artificial Sequence; identical to SEQ ID NO: 81099
  derived and/or modified sequence opt1 from neuraminidase__InfluenzaA__AEA10316

SEQ ID NO: 81516 - RNA, 1410 nt, Artificial Sequence; identical to SEQ ID NO: 77746
  derived and/or modified sequence opt1 from neuraminidase__InfluenzaA__AEA10326

SEQ ID NO: 81517 - RNA, 1410 nt, Artificial Sequence; identical to SEQ ID NO: 79034
  derived and/or modified sequence opt1 from neuraminidase__InfluenzaA__AEA10335

SEQ ID NO: 81518 - RNA, 1410 nt, Artificial Sequence; identical to SEQ ID NO: 77746
  derived and/or modified sequence opt1 from neuraminidase__InfluenzaA__AEA10342

SEQ ID NO: 81519 - RNA, 1410 nt, Artificial Sequence
  derived and/or modified sequence opt1 from neuraminidase__InfluenzaA__AEA10352
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcucccccgucagcuccaacggcgccaacggggugaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 81520 - RNA, 1410 nt, Artificial Sequence; identical to SEQ ID NO: 77746
  derived and/or modified sequence opt1 from neuraminidase__InfluenzaA__AEA48991

SEQ ID NO: 81521 - RNA, 1410 nt, Artificial Sequence; identical to SEQ ID NO: 80418
  derived and/or modified sequence opt1 from neuraminidase__InfluenzaA__AEA72707

SEQ ID NO: 81522 - RNA, 1410 nt, Artificial Sequence; identical to SEQ ID NO: 80418
  derived and/or modified sequence opt1 from neuraminidase__InfluenzaA__AEA72718

SEQ ID NO: 81523 - RNA, 1410 nt, Artificial Sequence; identical to SEQ ID NO: 80418
  derived and/or modified sequence opt1 from neuraminidase__InfluenzaA__AEA72729

SEQ ID NO: 81524 - RNA, 1410 nt, Artificial Sequence
  derived and/or modified sequence opt1 from neuraminidase__InfluenzaA__AEA72742
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81525 - RNA, 1410 nt, Artificial Sequence; identical to SEQ ID NO: 80021
  derived and/or modified sequence opt1 from neuraminidase__InfluenzaA__AEA72779

SEQ ID NO: 81526 - RNA, 1410 nt, Artificial Sequence
  derived and/or modified sequence opt1 from neuraminidase__InfluenzaA__AEA72789
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacgacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81527 - RNA, 1410 nt, Artificial Sequence; identical to SEQ ID NO: 80418
  derived and/or modified sequence opt1 from neuraminidase__InfluenzaA__AEA73291

SEQ ID NO: 81528 - RNA, 1410 nt, Artificial Sequence; identical to SEQ ID NO: 80418
  derived and/or modified sequence opt1 from neuraminidase__InfluenzaA__AEA73302

SEQ ID NO: 81529 - RNA, 1410 nt, Artificial Sequence; identical to SEQ ID NO: 80418
  derived and/or modified sequence opt1 from neuraminidase__InfluenzaA__AEA73313

SEQ ID NO: 81530 - RNA, 1410 nt, Artificial Sequence; identical to SEQ ID NO: 80418
  derived and/or modified sequence opt1 from neuraminidase__InfluenzaA__AEA73324

SEQ ID NO: 81531 - RNA, 1410 nt, Artificial Sequence; identical to SEQ ID NO: 80418
  derived and/or modified sequence opt1 from neuraminidase__InfluenzaA__AEA73335

SEQ ID NO: 81532 - RNA, 1410 nt, Artificial Sequence; identical to SEQ ID NO: 80418
  derived and/or modified sequence opt1 from neuraminidase__InfluenzaA__AEA73346

SEQ ID NO: 81533 - RNA, 1410 nt, Artificial Sequence; identical to SEQ ID NO: 80418
  derived and/or modified sequence opt1 from neuraminidase__InfluenzaA__AEA73357

SEQ ID NO: 81534 - RNA, 1410 nt, Artificial Sequence; identical to SEQ ID NO: 80418
  derived and/or modified sequence opt1 from neuraminidase__InfluenzaA__AEA73368

SEQ ID NO: 81535 - RNA, 1410 nt, Artificial Sequence; identical to SEQ ID NO: 80418
  derived and/or modified sequence opt1 from neuraminidase__InfluenzaA__AEA73379

SEQ ID NO: 81536 - RNA, 1410 nt, Artificial Sequence; identical to SEQ ID NO: 80418
  derived and/or modified sequence opt1 from neuraminidase__InfluenzaA__AEA73390

SEQ ID NO: 81537 - RNA, 1410 nt, Artificial Sequence; identical to SEQ ID NO: 80418
  derived and/or modified sequence opt1 from neuraminidase__InfluenzaA__AEA73401

SEQ ID NO: 81538 - RNA, 1410 nt, Artificial Sequence; identical to SEQ ID NO: 80418
  derived and/or modified sequence opt1 from neuraminidase__InfluenzaA__AEA73412

SEQ ID NO: 81539 - RNA, 1410 nt, Artificial Sequence; identical to SEQ ID NO: 80418
  derived and/or modified sequence opt1 from neuraminidase__InfluenzaA__AEA73423

SEQ ID NO: 81540 - RNA, 1410 nt, Artificial Sequence; identical to SEQ ID NO: 80418
  derived and/or modified sequence opt1 from neuraminidase__InfluenzaA__AEA73455

SEQ ID NO: 81541 - RNA, 1410 nt, Artificial Sequence; identical to SEQ ID NO: 80418
  derived and/or modified sequence opt1 from neuraminidase__InfluenzaA__AEA73466

SEQ ID NO: 81542 - RNA, 1410 nt, Artificial Sequence
  derived and/or modified sequence opt1 from neuraminidase__InfluenzaA__AEA73477
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccaaggugcuguggaccagcaacuccaucgucguguucugcggcacgagcgggaccuacggcaccggguccuggccggacggcgccgaccugaaccucaugcccaucuga

SEQ ID NO: 81543 - RNA, 1410 nt, Artificial Sequence; identical to SEQ ID NO: 80418
  derived and/or modified sequence opt1 from neuraminidase__InfluenzaA__AEA73488

SEQ ID NO: 81544 - RNA, 1410 nt, Artificial Sequence
  derived and/or modified sequence opt1 from neuraminidase__InfluenzaA__AEA73499
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgaucaacaacgugcacuccaacaacaccguccgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggccggacggcgccgaccugaaccugaugcccaucuga

SEQ ID NO: 81545 - RNA, 1410 nt, Artificial Sequence; identical to SEQ ID NO: 80418
  derived and/or modified sequence opt1 from neuraminidase__InfluenzaA__AEA73510

SEQ ID NO: 81546 - RNA, 1410 nt, Artificial Sequence; identical to SEQ ID NO: 80418
  derived and/or modified sequence opt1 from neuraminidase__InfluenzaA__AEA73521

SEQ ID NO: 81547 - RNA, 1410 nt, Artificial Sequence; identical to SEQ ID NO: 80418
  derived and/or modified sequence opt1 from neuraminidase__InfluenzaA__AEA73532

SEQ ID NO: 81548 - RNA, 1410 nt, Artificial Sequence; identical to SEQ ID NO: 80418
  derived and/or modified sequence opt1 from neuraminidase__InfluenzaA__AEA73543

SEQ ID NO: 81549 - RNA, 1410 nt, Artificial Sequence; identical to SEQ ID NO: 80418
  derived and/or modified sequence opt1 from neuraminidase__InfluenzaA__AEA73554

SEQ ID NO: 81550 - RNA, 1410 nt, Artificial Sequence; identical to SEQ ID NO: 80418
  derived and/or modified sequence opt1 from neuraminidase__InfluenzaA__AEA73565

SEQ ID NO: 81551 - RNA, 1413 nt, Artificial Sequence; identical to SEQ ID NO: 78469
  derived and/or modified sequence opt1 from neuraminidase__InfluenzaA__AEA73576

SEQ ID NO: 81552 - RNA, 1413 nt, Artificial Sequence; identical to SEQ ID NO: 78469
  derived and/or modified sequence opt1 from neuraminidase__InfluenzaA__AEA73587

SEQ ID NO: 81553 - RNA, 1413 nt, Artificial Sequence; identical to SEQ ID NO: 81212
  derived and/or modified sequence opt1 from neuraminidase__InfluenzaA__AEA73598

SEQ ID NO: 81554 - RNA, 1413 nt, Artificial Sequence; identical to SEQ ID NO: 78469
  derived and/or modified sequence opt1 from neuraminidase__InfluenzaA__AEA73609

SEQ ID NO: 81555 - RNA, 1413 nt, Artificial Sequence; identical to SEQ ID NO: 78469
  derived and/or modified sequence opt1 from neuraminidase__InfluenzaA__AEA73620

SEQ ID NO: 81556 - RNA, 1413 nt, Artificial Sequence
  derived and/or modified sequence opt1 from neuraminidase__InfluenzaA__AEA73631
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaucaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 81557 - RNA, 1413 nt, Artificial Sequence
  derived and/or modified sequence opt1 from neuraminidase__InfluenzaA__AEA73642
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaagcagcggaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccagcaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaucggcuacaucugcagcggcguguucggggacaacccccgccccgaggacggcgagggguccugcaacccggucaccguggacggcgccaacggggugaagggcuucagcuacaaguacggcaacggggucuggcugggccggacgaaguccaaccgccuccggaagggguucgagaugaucugggaccccaacggcuggaccaacaccgacagcgacuucuccgugaagcaggacguggucgccaucaccgacuggagcggguacagcggcuccuucgugcagcaccccgagcugacgggccuggacugcauccgccccugcuucuggguggagcucguccgggggcugccgcgcgagaacaccaccaucuggaccagcggcuccagcaucuccuucugcggggugaacagcgacacggccaacugguccuggcccgacggcgccgagcugcccuucaccaucgacaaguga

SEQ ID NO: 81558 - RNA, 1413 nt, Artificial Sequence; identical to SEQ ID NO: 78469
  derived and/or modified sequence opt1 from neuraminidase__InfluenzaA__AEA73653

SEQ ID NO: 81559 - RNA, 1413 nt, Artificial Sequence
  derived and/or modified sequence opt1 from neuraminidase__InfluenzaA__AEA73664
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgaaggagaacaccaccaucuggaccagcggcuccagcaucuccuucugcggggucaacagcgacacggccaacugguccuggcccgacggcgccgagcugcccuucaccaucgacaaguga

SEQ ID NO: 81560 - RNA, 1413 nt, Artificial Sequence
  derived and/or modified sequence opt1 from neuraminidase__InfluenzaA__AEA73675
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucuggaucgagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 81561 - RNA, 1413 nt, Artificial Sequence; identical to SEQ ID NO: 81212
  derived and/or modified sequence opt1 from neuraminidase__InfluenzaA__AEA73686

SEQ ID NO: 81562 - RNA, 1413 nt, Artificial Sequence
  derived and/or modified sequence opt1 from neuraminidase__InfluenzaA__AEA73697
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacaucguggcgggggaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcguggagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81563 - RNA, 1413 nt, Artificial Sequence; identical to SEQ ID NO: 81213
  derived and/or modified sequence opt1 from neuraminidase__InfluenzaA__AEA73708

SEQ ID NO: 81564 - RNA, 1413 nt, Artificial Sequence; identical to SEQ ID NO: 78469
  derived and/or modified sequence opt1 from neuraminidase__InfluenzaA__AEA73719

SEQ ID NO: 81565 - RNA, 1413 nt, Artificial Sequence; identical to SEQ ID NO: 78469
  derived and/or modified sequence opt1 from neuraminidase__InfluenzaA__AEA73730

SEQ ID NO: 81566 - RNA, 1413 nt, Artificial Sequence; identical to SEQ ID NO: 78469
  derived and/or modified sequence opt1 from neuraminidase__InfluenzaA__AEA73741

SEQ ID NO: 81567 - RNA, 1413 nt, Artificial Sequence; identical to SEQ ID NO: 78469
  derived and/or modified sequence opt1 from neuraminidase__InfluenzaA__AEA73752

SEQ ID NO: 81568 - RNA, 1413 nt, Artificial Sequence; identical to SEQ ID NO: 81212
  derived and/or modified sequence opt1 from neuraminidase__InfluenzaA__AEA73763

SEQ ID NO: 81569 - RNA, 1410 nt, Artificial Sequence; identical to SEQ ID NO: 77746
  derived and/or modified sequence opt1 from neuraminidase__InfluenzaA__AEA73774

SEQ ID NO: 81570 - RNA, 1410 nt, Artificial Sequence; identical to SEQ ID NO: 77746
  derived and/or modified sequence opt1 from neuraminidase__InfluenzaA__AEA73784

SEQ ID NO: 81571 - RNA, 1410 nt, Artificial Sequence; identical to SEQ ID NO: 77746
  derived and/or modified sequence opt1 from neuraminidase__InfluenzaA__AEA73794

SEQ ID NO: 81572 - RNA, 1410 nt, Artificial Sequence; identical to SEQ ID NO: 77746
  derived and/or modified sequence opt1 from neuraminidase__InfluenzaA__AEA73804

SEQ ID NO: 81573 - RNA, 1410 nt, Artificial Sequence; identical to SEQ ID NO: 77746
  derived and/or modified sequence opt1 from neuraminidase__InfluenzaA__AEA73814

SEQ ID NO: 81574 - RNA, 1410 nt, Artificial Sequence; identical to SEQ ID NO: 77746
  derived and/or modified sequence opt1 from neuraminidase__InfluenzaA__AEA73824

SEQ ID NO: 81575 - RNA, 1410 nt, Artificial Sequence
  derived and/or modified sequence opt1 from neuraminidase__InfluenzaA__AEA73834
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggaagaacaacauccugcgcacgcaggaguccgagugcgcgugcgucaacgggagcugcuucaccgugaugaccgacggcccguccgacggccaggccagcuacaagaucuuccggaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugagcuucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 81576 - RNA, 1410 nt, Artificial Sequence; identical to SEQ ID NO: 81108
  derived and/or modified sequence opt1 from neuraminidase__InfluenzaA__AEA73844

SEQ ID NO: 81577 - RNA, 1410 nt, Artificial Sequence; identical to SEQ ID NO: 77746
  derived and/or modified sequence opt1 from neuraminidase__InfluenzaA__AEA73854

SEQ ID NO: 81578 - RNA, 1410 nt, Artificial Sequence; identical to SEQ ID NO: 77746
  derived and/or modified sequence opt1 from neuraminidase__InfluenzaA__AEA73864

SEQ ID NO: 81579 - RNA, 1410 nt, Artificial Sequence; identical to SEQ ID NO: 79527
  derived and/or modified sequence opt1 from neuraminidase__InfluenzaA__AEA73874

SEQ ID NO: 81580 - RNA, 1410 nt, Artificial Sequence; identical to SEQ ID NO: 79527
  derived and/or modified sequence opt1 from neuraminidase__InfluenzaA__AEA73884

SEQ ID NO: 81581 - RNA, 1410 nt, Artificial Sequence; identical to SEQ ID NO: 81108
  derived and/or modified sequence opt1 from neuraminidase__InfluenzaA__AEA73894

SEQ ID NO: 81582 - RNA, 1410 nt, Artificial Sequence
  derived and/or modified sequence opt1 from neuraminidase__InfluenzaA__AEA73904
augaaccccaaccagaagaucaucaccaucggcagcgugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucugggucgagcucauccggggccgccccaaggagaagaccaucuggaccagcggguccagcaucuccuucugcggcgugaacagcgacaccgucgggugguccuggcccgacggcgccgagcugccguucacgaucgacaaguga

SEQ ID NO: 81583 - RNA, 1410 nt, Artificial Sequence; identical to SEQ ID NO: 77746
  derived and/or modified sequence opt1 from neuraminidase__InfluenzaA__AEA73914

SEQ ID NO: 81584 - RNA, 1410 nt, Artificial Sequence; identical to SEQ ID NO: 79527
  derived and/or modified sequence opt1 from neuraminidase__InfluenzaA__AEA73924

SEQ ID NO: 81585 - RNA, 1410 nt, Artificial Sequence; identical to SEQ ID NO: 81185
  derived and/or modified sequence opt1 from neuraminidase__InfluenzaA__AEA73934

SEQ ID NO: 81586 - RNA, 1410 nt, Artificial Sequence
  derived and/or modified sequence opt1 from neuraminidase__InfluenzaA__AEA73944
augaaccccaaccagaagaucaucaccaucggcagcgugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuacuacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81587 - RNA, 1410 nt, Artificial Sequence; identical to SEQ ID NO: 77746
  derived and/or modified sequence opt1 from neuraminidase__InfluenzaA__AEA73954

SEQ ID NO: 81588 - RNA, 1410 nt, Artificial Sequence; identical to SEQ ID NO: 77746
  derived and/or modified sequence opt1 from neuraminidase__InfluenzaA__AEA73964

SEQ ID NO: 81589 - RNA, 1410 nt, Artificial Sequence
  derived and/or modified sequence opt1 from neuraminidase__InfluenzaA__AEA73974
augaaccccaaccagaagaucaucaccaucggcagcgugugcaugaccaucgggauggccaaccugauccuccagaucggcaacaucaucuccaucuggaucagccacuccauccagcacgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 81590 - RNA, 1410 nt, Artificial Sequence; identical to SEQ ID NO: 77746
  derived and/or modified sequence opt1 from neuraminidase__InfluenzaA__AEA73984

SEQ ID NO: 81591 - RNA, 1410 nt, Artificial Sequence; identical to SEQ ID NO: 79097
  derived and/or modified sequence opt1 from neuraminidase__InfluenzaA__AEA73994

SEQ ID NO: 81592 - RNA, 1410 nt, Artificial Sequence
  derived and/or modified sequence opt1 from neuraminidase__InfluenzaA__AEA74004
augaaccccaacaagaagaucaucaucaucggcagcgugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 81593 - RNA, 1410 nt, Artificial Sequence; identical to SEQ ID NO: 78923
  derived and/or modified sequence opt1 from neuraminidase__InfluenzaA__AEA74014

SEQ ID NO: 81594 - RNA, 1410 nt, Artificial Sequence; identical to SEQ ID NO: 78923
  derived and/or modified sequence opt1 from neuraminidase__InfluenzaA__AEA74024

SEQ ID NO: 81595 - RNA, 1410 nt, Artificial Sequence; identical to SEQ ID NO: 77746
  derived and/or modified sequence opt1 from neuraminidase__InfluenzaA__AEA74032

SEQ ID NO: 81596 - RNA, 1410 nt, Artificial Sequence; identical to SEQ ID NO: 77746
  derived and/or modified sequence opt1 from neuraminidase__InfluenzaA__AEA74034

SEQ ID NO: 81597 - RNA, 1410 nt, Artificial Sequence
  derived and/or modified sequence opt1 from neuraminidase__InfluenzaA__AEA77302
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacccccaagaagaacgacuccagcuccagcucccacugccucgaccccaacaacgaggagggcgggcacggggucaagggcugggccuucgacgacgggaacgacguguggaugggccggaccaucagcgagaagucccgccugggcuacgagacguucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81598 - RNA, 1410 nt, Artificial Sequence; identical to SEQ ID NO: 81265
  derived and/or modified sequence opt1 from neuraminidase__InfluenzaA__AEB21318

SEQ ID NO: 81599 - RNA, 1410 nt, Artificial Sequence
  derived and/or modified sequence opt1 from neuraminidase__InfluenzaA__AEB21328
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacggguucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaugagcuucugcggcgucaacuccgacaccgugggguggagcuggcccgacggcgccgagcugccguucacgaucgacaaguga

SEQ ID NO: 81600 - RNA, 1410 nt, Artificial Sequence; identical to SEQ ID NO: 81265
  derived and/or modified sequence opt1 from neuraminidase__InfluenzaA__AEB21340

SEQ ID NO: 81601 - RNA, 1410 nt, Artificial Sequence
  derived and/or modified sequence opt1 from neuraminidase__InfluenzaA__AEB21350
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagccccuccgagugccgcaccuucuuccugacccagggcgcccugcucaacgacaagcacagcaacgggaccaucaaggaccggucccccuaccgcacgcugaugagcugcccgaucggcgagguccccagccccuacaacucccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucaucagccggaagggcuucgagaugaucugggaccccaacggguggaccggcaccgacaacaacuucuccaucaagcaggacaucgucgggaucaacgaguggagcggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 81602 - RNA, 1410 nt, Artificial Sequence; identical to SEQ ID NO: 81265
  derived and/or modified sequence opt1 from neuraminidase__InfluenzaA__AEB21360

SEQ ID NO: 81603 - RNA, 1410 nt, Artificial Sequence; identical to SEQ ID NO: 78613
  derived and/or modified sequence opt1 from neuraminidase__InfluenzaA__AEB40209

SEQ ID NO: 81604 - RNA, 1410 nt, Artificial Sequence; identical to SEQ ID NO: 77607
  derived and/or modified sequence opt1 from neuraminidase__InfluenzaA__AEB66898

SEQ ID NO: 81605 - RNA, 1413 nt, Artificial Sequence
  derived and/or modified sequence opt1 from neuraminidase__InfluenzaA__AEB71103
augaaccccaaccagaagaucaucaccaucggcagcgugucccuggggcucgucguguucaacgugcugcugcacgucgugagcaucaucgugaccgucguggugcucggcaacgacgggggcaacgggaucugcaacggcacggucgugaaggaguacaacgagaccgugcgcaucgagcgggucauccaguggcacaacaccuccgugguggaguacaucccguaccugaacggcgggaccuacacgaacaacaccgagagcgucugcgacgugaagggcuucgcccccuucuccaaggacaacggggugcgcaucggcagccgggggcacgucuucgugauccgcgagcccuucguguccugcagcccccgggagugccgcaccuucuuccugacccagggcucccuccugaacgacaagcacagcaacggcacggucaaggaccgguccccguucaagacccugaugagcguggagguggggcagucccccaacgucuaccaggcccgcuucgaggcgguggccuggagcgccaccgccugccacgacggcaagaaguggaugaccaucggggucacgggccccgacuccaaggccguggcggugguccacuacggcggggugcccaccgacaucaucaacagcugggccggcgacauccuccggacccaggaguccagcugcacgugcauccagggggacugcuacugggugaugaccgacggcccggccaaccgccaggcccaguaccggaucuacaaguccaaccaggggaagaucaucggccagauggacaucaacuucaacggcgggcacaucgaggagugcagcugcuaccccaacgacggcaaggucgagugcgugugccgcgacaacuggaccgggaccaaccggcccgugcuggucaucagccccgaccuguccuacaaggugggcuaccucugcgcggggcugccgagcgacacgccccgcggcgaggacgcccaguucuccggcagcugcaccucccccgucgggggccagggguacggcgugaagggguucggcuuccggcagggcaacgacguguggauggggcgcaccaucagccggaccucccgcagcggcuucgaggugauccgggucaagaacggguggacccagacguccaaggagcagauccgcaagcaggucgugguggacaaccugaacuggagcggcuacuccggcagcuucacccuccccaucgagcuguccggcaagagcugccuggugccgugcuucuggguggagaccauccgggggaagcccgaggagaagaccaucuggacguccagcuccagcaucgucaugugcgggguggacuacgagguggccgacugguccuggcacgacggcgccauccuccccuucgacaucgacaagauguga

SEQ ID NO: 81606 - RNA, 1413 nt, Artificial Sequence; identical to SEQ ID NO: 79938
  derived and/or modified sequence opt1 from neuraminidase__InfluenzaA__AEB71899

SEQ ID NO: 81607 - RNA, 1410 nt, Artificial Sequence
  derived and/or modified sequence opt1 from neuraminidase__InfluenzaA__AEB71910
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacguacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81608 - RNA, 1410 nt, Artificial Sequence; identical to SEQ ID NO: 77746
  derived and/or modified sequence opt1 from neuraminidase__InfluenzaA__AEB71919

SEQ ID NO: 81609 - RNA, 1410 nt, Artificial Sequence; identical to SEQ ID NO: 79492
  derived and/or modified sequence opt1 from neuraminidase__InfluenzaA__AEB71928

SEQ ID NO: 81610 - RNA, 1410 nt, Artificial Sequence
  derived and/or modified sequence opt1 from neuraminidase__InfluenzaA__AEB71939
augaaccccaaccagaagaucaucaccaucggcagcgugucccugaccaucagcgccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 81611 - RNA, 1410 nt, Artificial Sequence
  derived and/or modified sequence opt1 from neuraminidase__InfluenzaA__AEB71950
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggggaccacggcgucaaggggugggccuucgacgacggcaacgacguguggauggggcgcaccaucagcgagaagucccggcugggcuacgagaccuucaaggucaucgagggcuggagcaaccacaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggcccgacggggccgaccugaaccucaugccgaucuga

SEQ ID NO: 81612 - RNA, 1413 nt, Artificial Sequence; identical to SEQ ID NO: 80945
  derived and/or modified sequence opt1 from neuraminidase__InfluenzaA__AEB71961

SEQ ID NO: 81613 - RNA, 1410 nt, Artificial Sequence
  derived and/or modified sequence opt1 from neuraminidase__InfluenzaA__AEB71972
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgucaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 81614 - RNA, 1410 nt, Artificial Sequence
  derived and/or modified sequence opt1 from neuraminidase__InfluenzaA__AEB71983
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggcgcaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81615 - RNA, 1413 nt, Artificial Sequence
  derived and/or modified sequence opt1 from neuraminidase__InfluenzaA__AEB71995
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacaucaacaucaacaacacgaacgucguggcgggggaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccgugaacggcgcggacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggagugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 81616 - RNA, 1413 nt, Artificial Sequence; identical to SEQ ID NO: 81213
  derived and/or modified sequence opt1 from neuraminidase__InfluenzaA__AEC13316

SEQ ID NO: 81617 - RNA, 1410 nt, Artificial Sequence; identical to SEQ ID NO: 77746
  derived and/or modified sequence opt1 from neuraminidase__InfluenzaA__AEC53262

SEQ ID NO: 81618 - RNA, 1410 nt, Artificial Sequence; identical to SEQ ID NO: 77746
  derived and/or modified sequence opt1 from neuraminidase__InfluenzaA__AEC53272

SEQ ID NO: 81619 - RNA, 1410 nt, Artificial Sequence; identical to SEQ ID NO: 77746
  derived and/or modified sequence opt1 from neuraminidase__InfluenzaA__AEC53282

SEQ ID NO: 81620 - RNA, 1410 nt, Artificial Sequence; identical to SEQ ID NO: 77746
  derived and/or modified sequence opt1 from neuraminidase__InfluenzaA__AEC53292

SEQ ID NO: 81621 - RNA, 1410 nt, Artificial Sequence
  derived and/or modified sequence opt1 from neuraminidase__InfluenzaA__AEC53302
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaucaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 81622 - RNA, 1410 nt, Artificial Sequence; identical to SEQ ID NO: 77746
  derived and/or modified sequence opt1 from neuraminidase__InfluenzaA__AEC53350

SEQ ID NO: 81623 - RNA, 1410 nt, Artificial Sequence; identical to SEQ ID NO: 78454
  derived and/or modified sequence opt1 from neuraminidase__InfluenzaA__AEC53407

SEQ ID NO: 81624 - RNA, 1410 nt, Artificial Sequence; identical to SEQ ID NO: 77746
  derived and/or modified sequence opt1 from neuraminidase__InfluenzaA__AEC53427

SEQ ID NO: 81625 - RNA, 1410 nt, Artificial Sequence; identical to SEQ ID NO: 78572
  derived and/or modified sequence opt1 from neuraminidase__InfluenzaA__AED99967

SEQ ID NO: 81626 - RNA, 1410 nt, Artificial Sequence; identical to SEQ ID NO: 77736
  derived and/or modified sequence opt1 from neuraminidase__InfluenzaA__AEE27161

SEQ ID NO: 81627 - RNA, 1410 nt, Artificial Sequence; identical to SEQ ID NO: 77746
  derived and/or modified sequence opt1 from neuraminidase__InfluenzaA__AEE27170

SEQ ID NO: 81628 - RNA, 1410 nt, Artificial Sequence; identical to SEQ ID NO: 77736
  derived and/or modified sequence opt1 from neuraminidase__InfluenzaA__AEE27180

SEQ ID NO: 81629 - RNA, 1410 nt, Artificial Sequence
  derived and/or modified sequence opt1 from neuraminidase__InfluenzaA__AEE27190
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcgugaucaccgacaccaucaagagcuggcgcaacaacauccugcggacgcaggaguccgagugcgcgugcgucaacgggagcugcuucaccgugaugaccgacggcccguccaacggccaggccagcuacaagaucuucaagaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugagcuucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 81630 - RNA, 1410 nt, Artificial Sequence; identical to SEQ ID NO: 78969
  derived and/or modified sequence opt1 from neuraminidase__InfluenzaA__AEE27200

SEQ ID NO: 81631 - RNA, 1410 nt, Artificial Sequence; identical to SEQ ID NO: 80805
  derived and/or modified sequence opt1 from neuraminidase__InfluenzaA__AEG64755

SEQ ID NO: 81632 - RNA, 1362 nt, Artificial Sequence
  derived and/or modified sequence opt1 from neuraminidase__InfluenzaA__AEG64765
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccaggggaucaucaccuacaacgugguggccggccaggacuccaccagcgucauccugaccggcaacuccagccugugcccgauccgcgggugggccauccacuccaaggacaacggcauccggaucgggagcaagggcgacguguucgugauccgcgagcccuucaucuccugcagccaccucgagugccggacguucuuccugacccagggggcgcugcucaacgacaagcacuccaacggcaccgucaaggaccgcagccccuaccgggcccugauguccugccccgugggcgaggccccgagccccuacaacucccgcuucgagagcguggccugguccgccagcgcgugccacgacgggaugggcuggcugaccaucgggaucagcggccccgacaacggcgccgucgccgugcucaaguacaacgggaucaucacggagaccaucaaguccuggcggaagaagauccugcgcacccaggagagcgagugcacgugcgugaacggcuccugcuucaccaucaugaccgacgggcccagcgacggccuggccuccuacaagaucuucaagaucgagaaggggaaggucaccaagagcaucgagcucaacgcgccgaacucccacuacgaggagugcagcugcuaccccgacaccggcaaggugaugugcgugugccgggacaacuggcacggcuccaaccgccccugggucagcuucgaccagaaccuggacuaccagaucggguacaucugcuccggcguguucggggacaacccccggccgaaggacggcacggggagcugcggccccguguccgccgacggcgccaacggggucaagggcuucagcuaccgcuacgggaacggcguguggaucgggcggaccaaguccgacagcucccgccacggcuucgagaugaucugggaccccaacggcuggaccgagaccgacagccgguucuccgugcgccaggacgucguggccaugacggaccggagcggguacagcggcuccuucgugcagcaccccgagcugaccgggcucgacugcaugcgcccgugcuucugggucgagcugauccggggccgccccgaggagaagaccaucuggaccagcggcuccaucaucagcuucugcggggugaacuccgacacggucgacuggagcuggcccgacggcgccgagcugcccuucaccaucgacaaguga

SEQ ID NO: 81633 - RNA, 1410 nt, Artificial Sequence
  derived and/or modified sequence opt1 from neuraminidase__InfluenzaA__AEG64787
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaaccggcugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacgacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 81634 - RNA, 1410 nt, Artificial Sequence
  derived and/or modified sequence opt1 from neuraminidase__InfluenzaA__AEG64837
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagccugaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggccggacggcgccgaccucaaccugaugcccaucuga

SEQ ID NO: 81635 - RNA, 1410 nt, Artificial Sequence
  derived and/or modified sequence opt1 from neuraminidase__InfluenzaA__AEG64848
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggcugaagccgcagugcgacaucaccggguucgcgcccuucagcaaggacaacuccauccgccucagcgccggcggggacaucugggucacccgggagcccuacguguccugcgaccccgacaagugcuaccaguucgcccugggccaggggaccacgcugaacaacgugcacagcaacaacaccguccgcgaccggaccccguaccgcacccuccugaugaacgagcugggcgugcccuuccaccucggcacgaagcaggucugcaucgccugguccagcuccagcugccacgacgggaaggccuggcugcacgugugcaucaccggcgacgacaagaacgcgaccgccuccuucaucuacaacgggcggcugguggacagcguggucuccuggagcaaggagauccuccgcacccaggaguccgagugcgugugcaucaacggcacgugcaccguggucaugaccgacgggagcgccuccggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccucgugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcuccagaucaacaagcaggucaucguggaccgcggcaaccggagcggguacuccggcaucuucagcguggaggggaaguccugcaucaaccgcugcuucuacguggagcugauccggggccgcaaggaggagaccgaggugcuguggaccagcaacagcaucgucguguucugcggcacguccgggaccuacggcaccgggagcuggccggacggcgccgaccucaaccugaugcccaucuga

SEQ ID NO: 81636 - RNA, 1410 nt, Artificial Sequence; identical to SEQ ID NO: 75241
  derived and/or modified sequence opt1 from neuraminidase__InfluenzaA__AEG64859

SEQ ID NO: 81637 - RNA, 1410 nt, Artificial Sequence; identical to SEQ ID NO: 75069
  derived and/or modified sequence opt1 from neuraminidase__InfluenzaA__AEG64870

SEQ ID NO: 81638 - RNA, 1410 nt, Artificial Sequence; identical to SEQ ID NO: 75261
  derived and/or modified sequence opt1 from neuraminidase__InfluenzaA__AEG64881

SEQ ID NO: 81639 - RNA, 1410 nt, Artificial Sequence; identical to SEQ ID NO: 75069
  derived and/or modified sequence opt1 from neuraminidase__InfluenzaA__AEG64892

SEQ ID NO: 81640 - RNA, 1410 nt, Artificial Sequence; identical to SEQ ID NO: 75145
  derived and/or modified sequence opt1 from neuraminidase__InfluenzaA__AEG64914

SEQ ID NO: 81641 - RNA, 1410 nt, Artificial Sequence; identical to SEQ ID NO: 75145
  derived and/or modified sequence opt1 from neuraminidase__InfluenzaA__AEG64925

SEQ ID NO: 81642 - RNA, 1410 nt, Artificial Sequence
  derived and/or modified sequence opt1 from neuraminidase__InfluenzaA__AEG64936
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggaggacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcaccagcgggaccuacggcacgggguccuggccggacggcgccgacaucaaccugaugcccaucuga

SEQ ID NO: 81643 - RNA, 1410 nt, Artificial Sequence; identical to SEQ ID NO: 75158
  derived and/or modified sequence opt1 from neuraminidase__InfluenzaA__AEG64947

SEQ ID NO: 81644 - RNA, 1410 nt, Artificial Sequence; identical to SEQ ID NO: 75145
  derived and/or modified sequence opt1 from neuraminidase__InfluenzaA__AEG64958

SEQ ID NO: 81645 - RNA, 1410 nt, Artificial Sequence; identical to SEQ ID NO: 75145
  derived and/or modified sequence opt1 from neuraminidase__InfluenzaA__AEG64969

SEQ ID NO: 81646 - RNA, 1410 nt, Artificial Sequence; identical to SEQ ID NO: 75145
  derived and/or modified sequence opt1 from neuraminidase__InfluenzaA__AEG64980

SEQ ID NO: 81647 - RNA, 1410 nt, Artificial Sequence
  derived and/or modified sequence opt1 from neuraminidase__InfluenzaA__AEG64991
augaaccccaaccagaagaucaucaccaucggcagcgugucccugaccaucagcacgaucugcuucuucaugcagaucgccauccucaucaccaccgucacccugcacuucaagcaguacgaguccaacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcaacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaccaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 81648 - RNA, 1410 nt, Artificial Sequence; identical to SEQ ID NO: 75335
  derived and/or modified sequence opt1 from neuraminidase__InfluenzaA__AEG65002

SEQ ID NO: 81649 - RNA, 1410 nt, Artificial Sequence
  derived and/or modified sequence opt1 from neuraminidase__InfluenzaA__AEG65013
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggacauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggagcggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 81650 - RNA, 1410 nt, Artificial Sequence
  derived and/or modified sequence opt1 from neuraminidase__InfluenzaA__AEG65024
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccacgugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 81651 - RNA, 1410 nt, Artificial Sequence
  derived and/or modified sequence opt1 from neuraminidase__InfluenzaA__AEG65035
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccucgacaagugcuaccaguucgcccugggccaggggaccacgcugaacaacguccacuccaacgacaccgugcacgaccgcacccccuaccggacccuccugaugaacgagcugggcgugccguuccaccucggcacgaagcaggucugcaucgccuggagcuccagcuccugccacgacgggaaggccuggcugcacgugugcgugaccggcgacgacaagaacgcgaccgccagcuucaucuacaacgggcgccuggucgacuccaucgugagcugguccaaggagauccuccggacccaggagagcgagugcgugugcaucaacggcacgugcaccgucgugaugaccgacggguccgccagcggcaaggccgacaccaagauccuguucaucgaggagggcaagaucgugcacacgagcacccuguccgggagcgcgcagcacgucgaggagugcuccugcuacccccgcuaccccggcgugcggugcgugugccgcgacaacuggaaggggagcaaccggcccaucgucgacaucaacaucaaggacuacuccaucgugagcuccuacgugugcagcggccucgucggcgacaccccgcgcaagaacgacuccagcuccagcucccacugccuggaccccaacaacgaggagggcgggcacggggugaagggcugggccuucgacgacgggaacgacgucuggaugggccggaccaucagcgagaagcugcgcuccggcuacgagacguucaaggugaucgagggguggagcaaccccaacuccaagcuccagaucaaccgccaggugaucgucgaccggggcaaccggagcggguacuccggcaucuucagcguggagggcaagagcugcaucaaccgcugcuucuacguggagcugauccgggggcgcaaggaggagaacgagguccuguggaccuccaacagcaucgugguguucugcggcaccuccgggaccuacggcacggggagcuggcccgacggcgccgacaucaaccucaugccgaucuga

SEQ ID NO: 81652 - RNA, 1410 nt, Artificial Sequence; identical to SEQ ID NO: 75720
  derived and/or modified sequence opt1 from neuraminidase__InfluenzaA__AEG65057

SEQ ID NO: 81653 - RNA, 1410 nt, Artificial Sequence; identical to SEQ ID NO: 76715
  derived and/or modified sequence opt1 from neuraminidase__InfluenzaA__AEG65068

SEQ ID NO: 81654 - RNA, 1410 nt, Artificial Sequence
  derived and/or modified sequence opt1 from neuraminidase__InfluenzaA__AEG65079
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgaagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcgggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacagcaagcugcagaucaaccgccaggugaucguggaccgggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 81655 - RNA, 1410 nt, Artificial Sequence
  derived and/or modified sequence opt1 from neuraminidase__InfluenzaA__AEG65090
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucucccugaugcccaucuga

SEQ ID NO: 81656 - RNA, 1410 nt, Artificial Sequence
  derived and/or modified sequence opt1 from neuraminidase__InfluenzaA__AEG65101
augaaccccaaccagaagaucaucaccaucggcagcgugucccugaccaucagcacgaucugcuucuucaugcagaucgccauccucaucaccaccgucacccugcacuucaagcaguacgaguucaacuccccgcccgacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 81657 - RNA, 1410 nt, Artificial Sequence
  derived and/or modified sequence opt1 from neuraminidase__InfluenzaA__AEG65123
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacgcaggagagcgagugcgugugcaucaacgggaccugcaccgucgugaugaccgacggguccgccagcggcaaggccgacacgaagauccucuucaucgaggagggcaagaucgugcacaccagcacccuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcggccacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaacgagguccuguggaccagcaacuccaucgugguguucugcggcacgagcgggaccuacggcaccggguccuggccggacggcgccgacaucaaccucaugcccaucuga

SEQ ID NO: 81658 - RNA, 1410 nt, Artificial Sequence; identical to SEQ ID NO: 76715
  derived and/or modified sequence opt1 from neuraminidase__InfluenzaA__AEG65134

SEQ ID NO: 81659 - RNA, 1410 nt, Artificial Sequence
  derived and/or modified sequence opt1 from neuraminidase__InfluenzaA__AEG65145
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccaacagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcaccagcgggaccuacggcacgggguccuggccggacggcgccgacaucaaccugaugcccaucuga

SEQ ID NO: 81660 - RNA, 1410 nt, Artificial Sequence
  derived and/or modified sequence opt1 from neuraminidase__InfluenzaA__AEG65156
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacacgagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggacguacggcaccgggagcuggccggacggcgccgacaucaaccugaugcccaucuga

SEQ ID NO: 81661 - RNA, 1410 nt, Artificial Sequence
  derived and/or modified sequence opt1 from neuraminidase__InfluenzaA__AEG65167
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccggcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 81662 - RNA, 1410 nt, Artificial Sequence
  derived and/or modified sequence opt1 from neuraminidase__InfluenzaA__AEG65178
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaacauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 81663 - RNA, 1410 nt, Artificial Sequence
  derived and/or modified sequence opt1 from neuraminidase__InfluenzaA__AEG65189
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaacgacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81664 - RNA, 1410 nt, Artificial Sequence
  derived and/or modified sequence opt1 from neuraminidase__InfluenzaA__AEG65200
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggaggugcugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaccaaccgccaggugaucgucgaccggggcaaccggagcggguacuccggcaucuucagcguggagggcaagagcugcaucaaccgcugcuucuacguggagcucauccgggggcgcaaggaggagaccgagguccuguggaccuccaacagcaucgugguguucugcggcacguccgggaccuacggcaccgggagcuggccggacggcgccgacaucaaccugaugcccaucuga

SEQ ID NO: 81665 - RNA, 1410 nt, Artificial Sequence; identical to SEQ ID NO: 75720
  derived and/or modified sequence opt1 from neuraminidase__InfluenzaA__AEG65211

SEQ ID NO: 81666 - RNA, 1410 nt, Artificial Sequence; identical to SEQ ID NO: 75722
  derived and/or modified sequence opt1 from neuraminidase__InfluenzaA__AEG65222

SEQ ID NO: 81667 - RNA, 1410 nt, Artificial Sequence
  derived and/or modified sequence opt1 from neuraminidase__InfluenzaA__AEG65233
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucaucgacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 81668 - RNA, 1410 nt, Artificial Sequence
  derived and/or modified sequence opt1 from neuraminidase__InfluenzaA__AEG65244
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgcagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgccagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaccaggagaccgaggugcuguggaccuccaacagcaucguggucuucugcggcaccuccgggacguacggcaccgggagcuggccggacggcgccgacaucaaccugaugcccaucuga

SEQ ID NO: 81669 - RNA, 1410 nt, Artificial Sequence; identical to SEQ ID NO: 75722
  derived and/or modified sequence opt1 from neuraminidase__InfluenzaA__AEG65255

SEQ ID NO: 81670 - RNA, 1410 nt, Artificial Sequence; identical to SEQ ID NO: 75599
  derived and/or modified sequence opt1 from neuraminidase__InfluenzaA__AEG65266

SEQ ID NO: 81671 - RNA, 1410 nt, Artificial Sequence; identical to SEQ ID NO: 75599
  derived and/or modified sequence opt1 from neuraminidase__InfluenzaA__AEG65277

SEQ ID NO: 81672 - RNA, 1410 nt, Artificial Sequence
  derived and/or modified sequence opt1 from neuraminidase__InfluenzaA__AEG65288
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccagcuccagcugccacgacggcaaggccuggcugcacgugugcgugaccggggacgacaagaacgcgaccgccuccuucaucuacaacggccggcuggucgacagcaucggguccuggagcaagaagauccuccgcacccaggaguccgagugcgugugcaucaacggcacgugcaccguggucaugaccgacggcagcgccuccgggaaggccgacaccaagauccuguucaucgaggagggcaagaucgugcacaucagcacgcugagcggguccgcgcagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacaacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 81673 - RNA, 1410 nt, Artificial Sequence; identical to SEQ ID NO: 75599
  derived and/or modified sequence opt1 from neuraminidase__InfluenzaA__AEG65299

SEQ ID NO: 81674 - RNA, 1410 nt, Artificial Sequence; identical to SEQ ID NO: 75722
  derived and/or modified sequence opt1 from neuraminidase__InfluenzaA__AEG65310

SEQ ID NO: 81675 - RNA, 1410 nt, Artificial Sequence; identical to SEQ ID NO: 75722
  derived and/or modified sequence opt1 from neuraminidase__InfluenzaA__AEG65321

SEQ ID NO: 81676 - RNA, 1410 nt, Artificial Sequence; identical to SEQ ID NO: 75722
  derived and/or modified sequence opt1 from neuraminidase__InfluenzaA__AEG65332

SEQ ID NO: 81677 - RNA, 1410 nt, Artificial Sequence; identical to SEQ ID NO: 75722
  derived and/or modified sequence opt1 from neuraminidase__InfluenzaA__AEG65354

SEQ ID NO: 81678 - RNA, 1410 nt, Artificial Sequence; identical to SEQ ID NO: 75722
  derived and/or modified sequence opt1 from neuraminidase__InfluenzaA__AEG65365

SEQ ID NO: 81679 - RNA, 1410 nt, Artificial Sequence
  derived and/or modified sequence opt1 from neuraminidase__InfluenzaA__AEG65376
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgcagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 81680 - RNA, 1410 nt, Artificial Sequence; identical to SEQ ID NO: 75599
  derived and/or modified sequence opt1 from neuraminidase__InfluenzaA__AEG65387

SEQ ID NO: 81681 - RNA, 1410 nt, Artificial Sequence; identical to SEQ ID NO: 75599
  derived and/or modified sequence opt1 from neuraminidase__InfluenzaA__AEG65398

SEQ ID NO: 81682 - RNA, 1410 nt, Artificial Sequence; identical to SEQ ID NO: 75599
  derived and/or modified sequence opt1 from neuraminidase__InfluenzaA__AEG65409

SEQ ID NO: 81683 - RNA, 1410 nt, Artificial Sequence; identical to SEQ ID NO: 75599
  derived and/or modified sequence opt1 from neuraminidase__InfluenzaA__AEG65420

SEQ ID NO: 81684 - RNA, 1410 nt, Artificial Sequence; identical to SEQ ID NO: 75599
  derived and/or modified sequence opt1 from neuraminidase__InfluenzaA__AEG65431

SEQ ID NO: 81685 - RNA, 1410 nt, Artificial Sequence; identical to SEQ ID NO: 75720
  derived and/or modified sequence opt1 from neuraminidase__InfluenzaA__AEG65442

SEQ ID NO: 81686 - RNA, 1410 nt, Artificial Sequence; identical to SEQ ID NO: 75722
  derived and/or modified sequence opt1 from neuraminidase__InfluenzaA__AEG65453

SEQ ID NO: 81687 - RNA, 1410 nt, Artificial Sequence; identical to SEQ ID NO: 75722
  derived and/or modified sequence opt1 from neuraminidase__InfluenzaA__AEG65464

SEQ ID NO: 81688 - RNA, 1410 nt, Artificial Sequence; identical to SEQ ID NO: 75722
  derived and/or modified sequence opt1 from neuraminidase__InfluenzaA__AEG65475

SEQ ID NO: 81689 - RNA, 1410 nt, Artificial Sequence
  derived and/or modified sequence opt1 from neuraminidase__InfluenzaA__AEG65486
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgagcaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 81690 - RNA, 1410 nt, Artificial Sequence; identical to SEQ ID NO: 75722
  derived and/or modified sequence opt1 from neuraminidase__InfluenzaA__AEG65497

SEQ ID NO: 81691 - RNA, 1410 nt, Artificial Sequence; identical to SEQ ID NO: 75722
  derived and/or modified sequence opt1 from neuraminidase__InfluenzaA__AEG65508

SEQ ID NO: 81692 - RNA, 1410 nt, Artificial Sequence; identical to SEQ ID NO: 75722
  derived and/or modified sequence opt1 from neuraminidase__InfluenzaA__AEG65519

SEQ ID NO: 81693 - RNA, 1410 nt, Artificial Sequence; identical to SEQ ID NO: 75722
  derived and/or modified sequence opt1 from neuraminidase__InfluenzaA__AEG65530

SEQ ID NO: 81694 - RNA, 1410 nt, Artificial Sequence; identical to SEQ ID NO: 75722
  derived and/or modified sequence opt1 from neuraminidase__InfluenzaA__AEG65541

SEQ ID NO: 81695 - RNA, 1410 nt, Artificial Sequence
  derived and/or modified sequence opt1 from neuraminidase__InfluenzaA__AEG65563
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgaccgcugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaagaagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81696 - RNA, 1410 nt, Artificial Sequence
  derived and/or modified sequence opt1 from neuraminidase__InfluenzaA__AEG65574
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggagcugguccaagccgcagugcgacaucaccggguucgcgcccuucagcaaggacaacuccauccgccugagcgccggcggggacaucugggucacccgggagcccuacguguccugcgaccccgaccgcugcuaccaguucgcccucggccaggggaccacgcugaacaacgugcacagcaacgacaccguccacgaccggaccccguaccgcacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcggcugguggacagcaucgucuccuggagcaagaagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgcccgaucguggacaucaacaucaaggacuacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagcugcggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 81697 - RNA, 1410 nt, Artificial Sequence; identical to SEQ ID NO: 81695
  derived and/or modified sequence opt1 from neuraminidase__InfluenzaA__AEG65585

SEQ ID NO: 81698 - RNA, 1410 nt, Artificial Sequence; identical to SEQ ID NO: 81695
  derived and/or modified sequence opt1 from neuraminidase__InfluenzaA__AEG65596

SEQ ID NO: 81699 - RNA, 1410 nt, Artificial Sequence
  derived and/or modified sequence opt1 from neuraminidase__InfluenzaA__AEG65607
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgccagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 81700 - RNA, 1410 nt, Artificial Sequence
  derived and/or modified sequence opt1 from neuraminidase__InfluenzaA__AEG65629
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacgacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaucgaggugcuguggaccuccaacagcaucgucguguucugcggcaccuccgggaccuacggcacggggagcuggccggacggcgccgacaucaaccugaugcccaucuga

SEQ ID NO: 81701 - RNA, 1410 nt, Artificial Sequence; identical to SEQ ID NO: 81700
  derived and/or modified sequence opt1 from neuraminidase__InfluenzaA__AEG65640

SEQ ID NO: 81702 - RNA, 1410 nt, Artificial Sequence; identical to SEQ ID NO: 75143
  derived and/or modified sequence opt1 from neuraminidase__InfluenzaA__AEG65651

SEQ ID NO: 81703 - RNA, 1410 nt, Artificial Sequence; identical to SEQ ID NO: 75722
  derived and/or modified sequence opt1 from neuraminidase__InfluenzaA__AEG65662

SEQ ID NO: 81704 - RNA, 1410 nt, Artificial Sequence; identical to SEQ ID NO: 75722
  derived and/or modified sequence opt1 from neuraminidase__InfluenzaA__AEG65673

SEQ ID NO: 81705 - RNA, 1410 nt, Artificial Sequence; identical to SEQ ID NO: 75722
  derived and/or modified sequence opt1 from neuraminidase__InfluenzaA__AEG65684

SEQ ID NO: 81706 - RNA, 1410 nt, Artificial Sequence; identical to SEQ ID NO: 81679
  derived and/or modified sequence opt1 from neuraminidase__InfluenzaA__AEG65695

SEQ ID NO: 81707 - RNA, 1410 nt, Artificial Sequence
  derived and/or modified sequence opt1 from neuraminidase__InfluenzaA__AEG65706
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 81708 - RNA, 1410 nt, Artificial Sequence
  derived and/or modified sequence opt1 from neuraminidase__InfluenzaA__AEG65728
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgagaucaaccugaugcccaucuga

SEQ ID NO: 81709 - RNA, 1410 nt, Artificial Sequence
  derived and/or modified sequence opt1 from neuraminidase__InfluenzaA__AEG65739
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcccugcgagcccacgaucaucgagcgcaacaucaccgagaucguguaccugaccaacaccacgaucgagaaggagaucugcccgaagcucgccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccugggccaggggaccacgcucaacaacgugcacagcaacgacaccguccacgaccgcacccccuaccggacccugcugaugaacgagcucggcgugcccuuccaccugggcacgaagcaggucugcaucgccugguccagcuccagcugccacgacgggaaggccuggcugcacgugugcgugaccggcgacgacaagaacgcgaccgccuccuucaucuacaacgggcgccucguggacagcaucgucuccuggagcaaggagauccugcggacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgcuacccgggcguccggugcgugugccgcgacaacuggaagggguccaaccggcccaucguggacaucaacaugaaggacuacagcaucgucuccagcuacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucuccgagaagcuccgcagcggcuacgagaccuucaaggucaucgaggggugguccaacccgaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggcccgacggcgccgacaucaaccugaugcccaucuga

SEQ ID NO: 81710 - RNA, 1410 nt, Artificial Sequence; identical to SEQ ID NO: 77572
  derived and/or modified sequence opt1 from neuraminidase__InfluenzaA__AEG65750

SEQ ID NO: 81711 - RNA, 1410 nt, Artificial Sequence; identical to SEQ ID NO: 81708
  derived and/or modified sequence opt1 from neuraminidase__InfluenzaA__AEG65761

SEQ ID NO: 81712 - RNA, 1410 nt, Artificial Sequence
  derived and/or modified sequence opt1 from neuraminidase__InfluenzaA__AEG65772
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaugugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacgcaggagagcgagugcgugugcaucaacgggaccugcaccguggucaugaccgacggguccgccagcggcaaggccgacacgaagauccucuucaucgaggagggcaagaucauccacaccagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcggccacggggugaagggcugggccuucgacgacgggaacgacgucuggaugggccggaccaucagcgagaagcugcgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcacguccgggaccuacggcaccgggagcuggccggacggcgccgacaucaaccugaugcccaucuga

SEQ ID NO: 81713 - RNA, 1410 nt, Artificial Sequence; identical to SEQ ID NO: 80526
  derived and/or modified sequence opt1 from neuraminidase__InfluenzaA__AEG65783

SEQ ID NO: 81714 - RNA, 1410 nt, Artificial Sequence
  derived and/or modified sequence opt1 from neuraminidase__InfluenzaA__AEG65794
augaaccccaaccagaagaucaucaccaucggcagcgugucccugaccaucagcacgaucugcuucuucaugcagaucgccauccucaucaccaccaucacccugcacuucaagcaguacgaguucaacuccccgcccaacaaccaggucaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggacaagggcaaccgguccggguacagcggcaucuucuccguggagggcaagagcugcaucaaccgcugcuucuacgucgagcucauccgggggcgcaaggaggagaccgaggugcuguggaccagcaacuccaucguggucuucugcggcacgagcgggaccuacggcaccggguccuggccggacggcgccgaccugaaccucaugcccaucuga

SEQ ID NO: 81715 - RNA, 1410 nt, Artificial Sequence; identical to SEQ ID NO: 80526
  derived and/or modified sequence opt1 from neuraminidase__InfluenzaA__AEG65805

SEQ ID NO: 81716 - RNA, 1410 nt, Artificial Sequence
  derived and/or modified sequence opt1 from neuraminidase__InfluenzaA__AEG65816
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcgaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 81717 - RNA, 1410 nt, Artificial Sequence
  derived and/or modified sequence opt1 from neuraminidase__InfluenzaA__AEG79808
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81718 - RNA, 1410 nt, Artificial Sequence; identical to SEQ ID NO: 81717
  derived and/or modified sequence opt1 from neuraminidase__InfluenzaA__AEG79814

SEQ ID NO: 81719 - RNA, 1410 nt, Artificial Sequence
  derived and/or modified sequence opt1 from neuraminidase__InfluenzaA__AEG79826
augaaccccaaccagaagaucaucaccaucagcuccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagagcgagugcgcgugcgugaacggcuccugcuucaccaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggguccugcggccccgucagcuccaacggcgccaacggggugaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccaugggcuggagcuggcccgacggggccgagcugccguucacgaucgacaaguga

SEQ ID NO: 81720 - RNA, 1410 nt, Artificial Sequence
  derived and/or modified sequence opt1 from neuraminidase__InfluenzaA__AEG79830
augaaccccaaccagaagaucaucaccaucagcuccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggguccugcggccccgugagcuccaacggcgccaacggggugaagggcuucagcuucaaguacgggaacggcgucuggaucgggcgcaccaagagcaucuccagccggaagggcuucgagaugaucugggaccccaacggcuggaccgggaccgacaacaacuucuccaucaagcaggacaucgugggcaucaacgaguggagcggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 81721 - RNA, 1410 nt, Artificial Sequence; identical to SEQ ID NO: 81265
  derived and/or modified sequence opt1 from neuraminidase__InfluenzaA__AEG79836

SEQ ID NO: 81722 - RNA, 1410 nt, Artificial Sequence
  derived and/or modified sequence opt1 from neuraminidase__InfluenzaA__AEH59356
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcacccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuacuacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccgucuggaccagcggguccagcaucuccuucugcggcgugaacagcgacacggucgggugguccuggcccgacggcgccgagcugccguucaccaucgacaaguga

SEQ ID NO: 81723 - RNA, 1410 nt, Artificial Sequence; identical to SEQ ID NO: 81717
  derived and/or modified sequence opt1 from neuraminidase__InfluenzaA__AEH59360

SEQ ID NO: 81724 - RNA, 1410 nt, Artificial Sequence
  derived and/or modified sequence opt1 from neuraminidase__InfluenzaA__AEH59364
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcgccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucuccagccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 81725 - RNA, 1410 nt, Artificial Sequence
  derived and/or modified sequence opt1 from neuraminidase__InfluenzaA__AEH59366
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgggguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccaucaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaagggguucgagaugaucugggaccccaacggcuggaccgggaccgacaacaacuucagcaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 81726 - RNA, 1410 nt, Artificial Sequence; identical to SEQ ID NO: 81717
  derived and/or modified sequence opt1 from neuraminidase__InfluenzaA__AEH59368

SEQ ID NO: 81727 - RNA, 1410 nt, Artificial Sequence; identical to SEQ ID NO: 81265
  derived and/or modified sequence opt1 from neuraminidase__InfluenzaA__AEH59370

SEQ ID NO: 81728 - RNA, 1410 nt, Artificial Sequence; identical to SEQ ID NO: 81724
  derived and/or modified sequence opt1 from neuraminidase__InfluenzaA__AEH59372

SEQ ID NO: 81729 - RNA, 1410 nt, Artificial Sequence; identical to SEQ ID NO: 81724
  derived and/or modified sequence opt1 from neuraminidase__InfluenzaA__AEH59376

SEQ ID NO: 81730 - RNA, 1410 nt, Artificial Sequence; identical to SEQ ID NO: 81265
  derived and/or modified sequence opt1 from neuraminidase__InfluenzaA__AEH59378

SEQ ID NO: 81731 - RNA, 1410 nt, Artificial Sequence; identical to SEQ ID NO: 81724
  derived and/or modified sequence opt1 from neuraminidase__InfluenzaA__AEH59382

SEQ ID NO: 81732 - RNA, 1410 nt, Artificial Sequence
  derived and/or modified sequence opt1 from neuraminidase__InfluenzaA__AEH59384
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggcggaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 81733 - RNA, 1410 nt, Artificial Sequence
  derived and/or modified sequence opt1 from neuraminidase__InfluenzaA__AEH59386
augaaccccaaccagaagaucaucaccaucggcagcgugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 81734 - RNA, 1410 nt, Artificial Sequence; identical to SEQ ID NO: 81724
  derived and/or modified sequence opt1 from neuraminidase__InfluenzaA__AEH59388

SEQ ID NO: 81735 - RNA, 1410 nt, Artificial Sequence
  derived and/or modified sequence opt1 from neuraminidase__InfluenzaA__AEH59390
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggcugaacgaguggagcggcuacuccgggagcuucgugcagcacccggagcugacgggccucgacugcauccgccccugcuucuggguggagcugauccggggccugcccaaggagaacaccaucuggaccuccgggagcuccaucagcuucugcggcgucaacuccgacaccgugggguggagcuggcccgacggcgccgagcucccguucacgaucgacaaguga

SEQ ID NO: 81736 - RNA, 1410 nt, Artificial Sequence; identical to SEQ ID NO: 81724
  derived and/or modified sequence opt1 from neuraminidase__InfluenzaA__AEH59392

SEQ ID NO: 81737 - RNA, 1410 nt, Artificial Sequence; identical to SEQ ID NO: 81724
  derived and/or modified sequence opt1 from neuraminidase__InfluenzaA__AEH59396

SEQ ID NO: 81738 - RNA, 1410 nt, Artificial Sequence
  derived and/or modified sequence opt1 from neuraminidase__InfluenzaA__AEH59398
augaaccccaaccagaagaucaucaccaucggcagcgugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacuacauccugcggacgcaggaguccgagugcgcgugcgugaacgggagcugcuucaccaucaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81739 - RNA, 1410 nt, Artificial Sequence
  derived and/or modified sequence opt1 from neuraminidase__InfluenzaA__AEH59400
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgaacgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 81740 - RNA, 1410 nt, Artificial Sequence
  derived and/or modified sequence opt1 from neuraminidase__InfluenzaA__AEH59402
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcgccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucuccagccggaacggcuucgagaugaucugggaccccaacggguggaccgagaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggcggagcugccguucacgaucgacaaguga

SEQ ID NO: 81741 - RNA, 1410 nt, Artificial Sequence
  derived and/or modified sequence opt1 from neuraminidase__InfluenzaA__AEH59404
augaaccccaaccagaagaucaucaccaucggcagcgccugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgcggccggccagccgguggucuccgugaagcuggccgggaacagcucccucugccccgugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgcgugguccgccagcgccugccacgacgggaucaacuggcucaccaucggcaucuccggcccggacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgcccgugggugagcuucaaccagaaccucgaguaccagaucggguacaucugcuccggcaucuucggggacaacccccggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggacccgaacggguggaccggcaccgacaacaacuucagcaucaagcaggacaucguggggaucaacgagugguccggcuacagcggguccuucguccagcaccccgagcugacgggccuggacugcauccgccccugcuucuggguggagcucauccggggccgccccaaggagaacaccaucuggaccagcggguccagcaucuccuucugcggcgugaacagcgacaccgucgggugguccuggccggacggcgcggagcugcccuucacgaucgacaaguga

SEQ ID NO: 81742 - RNA, 1410 nt, Artificial Sequence
  derived and/or modified sequence opt1 from neuraminidase__InfluenzaA__AEH59406
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaccuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuucaacggggccaacggcgugaagggguucuccuucaaguacggcaacgggguguggaucggccgcaccaagagcaucagcucccggaagggcuucgagaugaucugggaccccaacggguggaccggcacggacaacaacuucagcaucaagcaggacaucgucgggaucgacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 81743 - RNA, 1410 nt, Artificial Sequence; identical to SEQ ID NO: 81265
  derived and/or modified sequence opt1 from neuraminidase__InfluenzaA__AEH59408

SEQ ID NO: 81744 - RNA, 1410 nt, Artificial Sequence
  derived and/or modified sequence opt1 from neuraminidase__InfluenzaA__AEH59412
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccauccgcuccuggcggaacaacauccugcgcacgcaggagagcgagugcgcgugcgugaacggguccugcuucaccaucaugaccgacggcccgagcgacggccaggccuccuacaagaucuuccggaucgagaaggggaagaucaucaagagcguggagaugaacgcccccaacuaccacuacgaggagugcuccugcuaccccgacagcuccgagaucacgugcgucugccgcgacaacuggcacggcagcaaccggcccuggguguccuucaaccagaaccucgaguaccagaucggguacaucugcagcggcaucuucggggacaacccgcgccccaacgacaagaccggcuccugcggccccgugcugagcaacggggccaacggcgucaagggguucuccuucaaguacggcaacgggguguggaucggccggaccaagagcaucagcucccgcaagggcuucgagaugaucugggaccccaacggguggaccggcaccgacaacaacuucagcaucaagcaggacaucguggggaucaacgagugguccggcuacagcggguccuucguccagcacccggagcugacgggccucgacugcauccggcccugcuucuggguggagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 81745 - RNA, 1410 nt, Artificial Sequence; identical to SEQ ID NO: 81717
  derived and/or modified sequence opt1 from neuraminidase__InfluenzaA__AEH59416

SEQ ID NO: 81746 - RNA, 1410 nt, Artificial Sequence; identical to SEQ ID NO: 77746
  derived and/or modified sequence opt1 from neuraminidase__InfluenzaA__AEH59584

SEQ ID NO: 81747 - RNA, 1410 nt, Artificial Sequence; identical to SEQ ID NO: 77746
  derived and/or modified sequence opt1 from neuraminidase__InfluenzaA__AEH59586

SEQ ID NO: 81748 - RNA, 1410 nt, Artificial Sequence; identical to SEQ ID NO: 77746
  derived and/or modified sequence opt1 from neuraminidase__InfluenzaA__AEH59588

SEQ ID NO: 81749 - RNA, 1410 nt, Artificial Sequence; identical to SEQ ID NO: 77746
  derived and/or modified sequence opt1 from neuraminidase__InfluenzaA__AEH59592

SEQ ID NO: 81750 - RNA, 1410 nt, Artificial Sequence; identical to SEQ ID NO: 77746
  derived and/or modified sequence opt1 from neuraminidase__InfluenzaA__AEH59594

SEQ ID NO: 81751 - RNA, 1410 nt, Artificial Sequence; identical to SEQ ID NO: 77746
  derived and/or modified sequence opt1 from neuraminidase__InfluenzaA__AEH59596

SEQ ID NO: 81752 - RNA, 1410 nt, Artificial Sequence; identical to SEQ ID NO: 77746
  derived and/or modified sequence opt1 from neuraminidase__InfluenzaA__AEH59598

SEQ ID NO: 81753 - RNA, 1410 nt, Artificial Sequence; identical to SEQ ID NO: 77746
  derived and/or modified sequence opt1 from neuraminidase__InfluenzaA__AEH59600

SEQ ID NO: 81754 - RNA, 1410 nt, Artificial Sequence
  derived and/or modified sequence opt1 from neuraminidase__InfluenzaA__AEH59602
augaaccccaaccagaagaucaucaccaucggcagcgugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81755 - RNA, 1410 nt, Artificial Sequence; identical to SEQ ID NO: 77746
  derived and/or modified sequence opt1 from neuraminidase__InfluenzaA__AEH59606

SEQ ID NO: 81756 - RNA, 1410 nt, Artificial Sequence; identical to SEQ ID NO: 77746
  derived and/or modified sequence opt1 from neuraminidase__InfluenzaA__AEH59616

SEQ ID NO: 81757 - RNA, 1410 nt, Artificial Sequence; identical to SEQ ID NO: 77746
  derived and/or modified sequence opt1 from neuraminidase__InfluenzaA__AEH59626

SEQ ID NO: 81758 - RNA, 1413 nt, Artificial Sequence; identical to SEQ ID NO: 78469
  derived and/or modified sequence opt1 from neuraminidase__InfluenzaA__AEH77262

SEQ ID NO: 81759 - RNA, 1410 nt, Artificial Sequence
  derived and/or modified sequence opt1 from neuraminidase__InfluenzaA__AEH77273
augaaccccaaccagaagaucaucaccaucggcagcgugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 81760 - RNA, 1410 nt, Artificial Sequence
  derived and/or modified sequence opt1 from neuraminidase__InfluenzaA__AEH77282
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucgucgaggagggcaagaucgugcacaucagcacgcugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuccagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggugaucgucgagcggggcaaccgcuccggguacagcggcaucuucuccguggagggcaagagcugcaucaaccggugcuucuacguggagcugauccgcgggcggaaggaggagaccgaggucugguggaccagcaacuccaucgugguguucugcggcaccagcgggaccuacggcacgggguccuggccggacggcgccgacaucaaccugaugcccaucuga

SEQ ID NO: 81761 - RNA, 1410 nt, Artificial Sequence; identical to SEQ ID NO: 77746
  derived and/or modified sequence opt1 from neuraminidase__InfluenzaA__AEI29218

SEQ ID NO: 81762 - RNA, 1410 nt, Artificial Sequence; identical to SEQ ID NO: 79113
  derived and/or modified sequence opt1 from neuraminidase__InfluenzaA__AEI29228

SEQ ID NO: 81763 - RNA, 1410 nt, Artificial Sequence; identical to SEQ ID NO: 75145
  derived and/or modified sequence opt1 from neuraminidase__InfluenzaA__AEI54350

SEQ ID NO: 81764 - RNA, 1410 nt, Artificial Sequence; identical to SEQ ID NO: 75158
  derived and/or modified sequence opt1 from neuraminidase__InfluenzaA__AEI54361

SEQ ID NO: 81765 - RNA, 1410 nt, Artificial Sequence; identical to SEQ ID NO: 75722
  derived and/or modified sequence opt1 from neuraminidase__InfluenzaA__AEI54372

SEQ ID NO: 81766 - RNA, 1410 nt, Artificial Sequence; identical to SEQ ID NO: 75599
  derived and/or modified sequence opt1 from neuraminidase__InfluenzaA__AEI54383

SEQ ID NO: 81767 - RNA, 1410 nt, Artificial Sequence; identical to SEQ ID NO: 75722
  derived and/or modified sequence opt1 from neuraminidase__InfluenzaA__AEI54394

SEQ ID NO: 81768 - RNA, 1410 nt, Artificial Sequence; identical to SEQ ID NO: 76892
  derived and/or modified sequence opt1 from neuraminidase__InfluenzaA__AEI54416

SEQ ID NO: 81769 - RNA, 1410 nt, Artificial Sequence; identical to SEQ ID NO: 81712
  derived and/or modified sequence opt1 from neuraminidase__InfluenzaA__AEI54427

SEQ ID NO: 81770 - RNA, 1410 nt, Artificial Sequence; identical to SEQ ID NO: 80526
  derived and/or modified sequence opt1 from neuraminidase__InfluenzaA__AEI54438

SEQ ID NO: 81771 - RNA, 1410 nt, Artificial Sequence; identical to SEQ ID NO: 80526
  derived and/or modified sequence opt1 from neuraminidase__InfluenzaA__AEI54449

SEQ ID NO: 81772 - RNA, 1410 nt, Artificial Sequence; identical to SEQ ID NO: 80526
  derived and/or modified sequence opt1 from neuraminidase__InfluenzaA__AEI54460

SEQ ID NO: 81773 - RNA, 1410 nt, Artificial Sequence
  derived and/or modified sequence opt1 from neuraminidase__InfluenzaA__AEI54471
augaaccccaaccagaagaucaucaccaucggcagcgugucccugaccaucagcacgaucugcuucuucaugcagaucgccguccucaucaccaccgugacccugcacuucaagcaguacaaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 81774 - RNA, 1410 nt, Artificial Sequence; identical to SEQ ID NO: 80418
  derived and/or modified sequence opt1 from neuraminidase__InfluenzaA__AEI54482

SEQ ID NO: 81775 - RNA, 1410 nt, Artificial Sequence
  derived and/or modified sequence opt1 from neuraminidase__InfluenzaA__AEI54493
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugagcaucuga

SEQ ID NO: 81776 - RNA, 1410 nt, Artificial Sequence; identical to SEQ ID NO: 80526
  derived and/or modified sequence opt1 from neuraminidase__InfluenzaA__AEI54504

SEQ ID NO: 81777 - RNA, 1410 nt, Artificial Sequence; identical to SEQ ID NO: 80046
  derived and/or modified sequence opt1 from neuraminidase__InfluenzaA__AEI59982

SEQ ID NO: 81778 - RNA, 1413 nt, Artificial Sequence; identical to SEQ ID NO: 80944
  derived and/or modified sequence opt1 from neuraminidase__InfluenzaA__AEI59993

SEQ ID NO: 81779 - RNA, 1413 nt, Artificial Sequence; identical to SEQ ID NO: 80940
  derived and/or modified sequence opt1 from neuraminidase__InfluenzaA__AEI60004

SEQ ID NO: 81780 - RNA, 1410 nt, Artificial Sequence
  derived and/or modified sequence opt1 from neuraminidase__InfluenzaA__AEI60015
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggaacggcgucaaggggugggccuucgacgacggcaacgacguguggaugggccgcaccaucuccgagaagucccggcugggguacgagaccuucaaggucaucgagggcuggagcaaccacaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggaccagcggcacguacgggaccggcuccuggcccgacggggccgaccugaaccucaugccgaucuga

SEQ ID NO: 81781 - RNA, 1410 nt, Artificial Sequence; identical to SEQ ID NO: 79492
  derived and/or modified sequence opt1 from neuraminidase__InfluenzaA__AEI60026

SEQ ID NO: 81782 - RNA, 1410 nt, Artificial Sequence
  derived and/or modified sequence opt1 from neuraminidase__InfluenzaA__AEI60037
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggcgcaacgacuccagcuccagcucccacugccucgaccccaacaacgaggagggcgggcacggggucaagggcugggccuucgacgacgggaacgacguguggaugggccggaccaucagcgagaagucccgccugggcuacgagaccuucaaggucaucgagggguggagcaaccacaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgaccugaaccucaugccgaucuga

SEQ ID NO: 81783 - RNA, 1410 nt, Artificial Sequence
  derived and/or modified sequence opt1 from neuraminidase__InfluenzaA__AEI60048
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgcccccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggcggacaccaagauccucuucaucgaggagggcaagaucgugcacacgagcacccuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81784 - RNA, 1410 nt, Artificial Sequence
  derived and/or modified sequence opt1 from neuraminidase__InfluenzaA__AEI60089
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuacuacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81785 - RNA, 1410 nt, Artificial Sequence; identical to SEQ ID NO: 81717
  derived and/or modified sequence opt1 from neuraminidase__InfluenzaA__AEI60099

SEQ ID NO: 81786 - RNA, 1410 nt, Artificial Sequence
  derived and/or modified sequence opt1 from neuraminidase__InfluenzaA__AEI60111
augaaccccaaccagaagaucaucaccaucggcagcaucucccugaccaucgccacgaucugcuuccucaugcagaucgccauccuggugaccaccgucacccugcacuucaagcaguacaagugcaacagcccgcccaacaaccgcgugaugcucugcgagcccacgaucaucgagcggaacaucaccgagaucguguaccugaccaacaccacgaucgagaaggagaucugccccaagcuggcggaguaccgcaacugguccaagccgcagugcaacaucaagggguucgcccccuucagcaaggacaacuccauccggcucagcgccggcggggacaucugggucacccgcgagcccuacguguccugcgaccccgacaagugcuaccaguucgcccugggccaggggaccacccugaacaacggccacagcaacgacacggugcacgaccggaccccguaccgcacccuccugaugaacgagcugggcguccccuuccaccucgggacccgccaggugugcaucgccugguccagcuccagcugccacgacggcaaggcguggcugcacgugugcaucacgggggacgacgagaacgccaccgccuccuucaucuacaacggccggcuggucgacagcaucggguccuggagcaagaagauccuccggacccaggaguccgagugcgugugcaucaacgggaccugcacgguggucaugaccgacggcagcgccuccgggaaggcggacaccaagauccuguucaucgaggagggcaagaucgugcacaucagcacccugagcggguccgcccagcacguggaggagugcagcugcuacccccgcuaccccggcguccggugcgugugccgcgacaacuggaagggcuccaaccggccgaucguggacaucaacguccgcgacuacagcaucguguccagcuacgugugcuccgggcucgucggcgacacgccccggaagaacgacagcuucuccagcucccacugccuggaccccaacaacgaggagggcggccacggggugaagggcugggccuucgacgacggcaacgacguguggauggggcgcaccaucagcgagaagcugcgguccggcuacgagaccuucaaggucaucgagggguggagcaagcccaacuccaagcuccaggugaaccgccaggucaucguggagcggggcaaccgcagcggguacuccggcaucuucagcguggagggcaaguccugcaucaaccggugcuucuacgucgagcugauccgcgggcgcaaggaggagaccaaggugugguggacgagcaacagcaucguggucuucugcggcaccuccgggaccuacggcaccgggagcuggccggacggcgccgacaucaacaucaugcccaucuga

SEQ ID NO: 81787 - RNA, 1410 nt, Artificial Sequence; identical to SEQ ID NO: 77746
  derived and/or modified sequence opt1 from neuraminidase__InfluenzaA__AEI73669

SEQ ID NO: 81788 - RNA, 1410 nt, Artificial Sequence
  derived and/or modified sequence opt1 from neuraminidase__InfluenzaA__AEI86727
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagcaaguucgagagcguggccugguccgcgagcgccugccacgacgggaucuccuggcucaccaucggcaucagcggccccgacaacggggccguggccguccugaaguacaacggcaucaucaccgacaccaucaaguccuggcggaacaacauccugcgcacgcaggagagcgagugcgcgugcgugaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 81789 - RNA, 1410 nt, Artificial Sequence
  derived and/or modified sequence opt1 from neuraminidase__InfluenzaA__AEI86737
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81790 - RNA, 1410 nt, Artificial Sequence
  derived and/or modified sequence opt1 from neuraminidase__InfluenzaA__AEI86757
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucaucucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81791 - RNA, 1410 nt, Artificial Sequence
  derived and/or modified sequence opt1 from neuraminidase__InfluenzaA__AEI86767
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81792 - RNA, 1410 nt, Artificial Sequence; identical to SEQ ID NO: 81791
  derived and/or modified sequence opt1 from neuraminidase__InfluenzaA__AEI86777

SEQ ID NO: 81793 - RNA, 1410 nt, Artificial Sequence
  derived and/or modified sequence opt1 from neuraminidase__InfluenzaA__AEI86787
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81794 - RNA, 1410 nt, Artificial Sequence
  derived and/or modified sequence opt1 from neuraminidase__InfluenzaA__AEI86797
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81795 - RNA, 1410 nt, Artificial Sequence
  derived and/or modified sequence opt1 from neuraminidase__InfluenzaA__AEI86807
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcaagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 81796 - RNA, 1410 nt, Artificial Sequence; identical to SEQ ID NO: 81791
  derived and/or modified sequence opt1 from neuraminidase__InfluenzaA__AEI86817

SEQ ID NO: 81797 - RNA, 1410 nt, Artificial Sequence
  derived and/or modified sequence opt1 from neuraminidase__InfluenzaA__AEI86827
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaccuccagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccugaacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 81798 - RNA, 1410 nt, Artificial Sequence; identical to SEQ ID NO: 81794
  derived and/or modified sequence opt1 from neuraminidase__InfluenzaA__AEI86837

SEQ ID NO: 81799 - RNA, 1410 nt, Artificial Sequence; identical to SEQ ID NO: 81265
  derived and/or modified sequence opt1 from neuraminidase__InfluenzaA__AEI86847

SEQ ID NO: 81800 - RNA, 1410 nt, Artificial Sequence
  derived and/or modified sequence opt1 from neuraminidase__InfluenzaA__AEI86867
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagcaaguucgagagcguggccugguccgcgagcgccugccacgacgggaucaacuggcugaccaucggcaucuccggccccgacaacggggccguggccguccugaaguacaacggcaucaucaccgacaccaucaagagcuggcggaacaacauccuccgcacgcaggaguccgagugcgcgugcgugaacgggagcugcuucaccaucaugaccgacggcccguccgacggccaggccagcuacaagaucuuccggaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugagcuucaaccagaaccuggaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 81801 - RNA, 1410 nt, Artificial Sequence; identical to SEQ ID NO: 81794
  derived and/or modified sequence opt1 from neuraminidase__InfluenzaA__AEI86887

SEQ ID NO: 81802 - RNA, 1410 nt, Artificial Sequence; identical to SEQ ID NO: 81794
  derived and/or modified sequence opt1 from neuraminidase__InfluenzaA__AEI86897

SEQ ID NO: 81803 - RNA, 1410 nt, Artificial Sequence
  derived and/or modified sequence opt1 from neuraminidase__InfluenzaA__AEI86907
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacauccacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81804 - RNA, 1410 nt, Artificial Sequence
  derived and/or modified sequence opt1 from neuraminidase__InfluenzaA__AEI86917
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81805 - RNA, 1410 nt, Artificial Sequence; identical to SEQ ID NO: 81717
  derived and/or modified sequence opt1 from neuraminidase__InfluenzaA__AEI86927

SEQ ID NO: 81806 - RNA, 1410 nt, Artificial Sequence; identical to SEQ ID NO: 81791
  derived and/or modified sequence opt1 from neuraminidase__InfluenzaA__AEI86937

SEQ ID NO: 81807 - RNA, 1410 nt, Artificial Sequence
  derived and/or modified sequence opt1 from neuraminidase__InfluenzaA__AEI86947
augaaccccaaccagaagaucaucaccaucggcagcgugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81808 - RNA, 1410 nt, Artificial Sequence
  derived and/or modified sequence opt1 from neuraminidase__InfluenzaA__AEI86967
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacgccuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 81809 - RNA, 1410 nt, Artificial Sequence
  derived and/or modified sequence opt1 from neuraminidase__InfluenzaA__AEI86977
augaaccccaaccagaagaucaucaccaucggcagcgugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcacgugcgugaacggcagcugcuucaccgugaugaccgacggcccguccgacgggcaggcgagcuacaagaucuucaagaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccggcagcugcgggcccguguccagcaacggcgccaacggggugaagggcuucuccuucaaguacgggaacggcgucuggaucggccggaccaagagcaucagcucccgcaacggguucgagaugaucugggaccccaacggcuggaccgggaccgacaacaacuucagcaucaagcaggacaucgugggcaucaacgagugguccggguacagcggcuccuucgugcagcacccggagcugaccggccuggacugcauccggcccugcuucugggucgagcucauccgcgggcggcccaaggagaacaccaucuggaccagcggcuccagcaucuccuucugcggggugaacagcgacacggucggcugguccuggcccgacggcgccgagcugccguucaccaucgacaaguga

SEQ ID NO: 81810 - RNA, 1410 nt, Artificial Sequence
  derived and/or modified sequence opt1 from neuraminidase__InfluenzaA__AEI86997
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 81811 - RNA, 1410 nt, Artificial Sequence
  derived and/or modified sequence opt1 from neuraminidase__InfluenzaA__AEI87007
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucagcuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucagcuucaaguacggcaacggggucuggaucggccgcaccaaguccaucagcucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 81812 - RNA, 1410 nt, Artificial Sequence
  derived and/or modified sequence opt1 from neuraminidase__InfluenzaA__AEI87017
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacggggacaccggcggcuggagcuggcccgacggggccgagcugccguucacgaucgacaaguga

SEQ ID NO: 81813 - RNA, 1410 nt, Artificial Sequence; identical to SEQ ID NO: 81717
  derived and/or modified sequence opt1 from neuraminidase__InfluenzaA__AEI87027

SEQ ID NO: 81814 - RNA, 1410 nt, Artificial Sequence; identical to SEQ ID NO: 81810
  derived and/or modified sequence opt1 from neuraminidase__InfluenzaA__AEI87037

SEQ ID NO: 81815 - RNA, 1410 nt, Artificial Sequence; identical to SEQ ID NO: 81794
  derived and/or modified sequence opt1 from neuraminidase__InfluenzaA__AEI87047

SEQ ID NO: 81816 - RNA, 1410 nt, Artificial Sequence
  derived and/or modified sequence opt1 from neuraminidase__InfluenzaA__AEI87057
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81817 - RNA, 1410 nt, Artificial Sequence; identical to SEQ ID NO: 81265
  derived and/or modified sequence opt1 from neuraminidase__InfluenzaA__AEI87067

SEQ ID NO: 81818 - RNA, 1410 nt, Artificial Sequence
  derived and/or modified sequence opt1 from neuraminidase__InfluenzaA__AEI87077
augaaccccaaccagaagaucaucaccaucggcagcaucugcaugaccaucgggauggccaaccugauccuccagaucggcaacaucaucuccaucuggaucagccacuccauccaguucgggaaccagaaccagaucggcacgugcaaccagagcgugaucaccuacgagaacaacaccugggucaaccagaccuacgugaacaucuccaacacgaacuucgccgcggggcagagcguggucuccgugaagcuggccggcaacagcucccugugcccggugagcggcugggccaucuacuccaaggacaacagcauccgcaucggguccaagggcgacgucuucgugauccgggagcccuucaucagcugcagcccccucgagugccgcaccuucuuccugacccagggggcccugcucaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcugaccaucggcaucuccgggcccgacaacggcgccguggccgugcucaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccuggaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaagggguucgagaugaucugggaccccaacggcuggaccgggaccgacaacaacuucagcaucaagcaggacaucgugggcaucaacgagugguccggguacagcggcuccuucguccagcacccggagcucacgggccuggacugcauccgccccugcuucuggguggagcugauccgggggcgccccaaggagaacaccaucuggaccagcggcuccagcaucuccuucugcggggugaacagcgacaccgucggcugguccuggcccgacggcgccgagcucccguucacgaucgacaaguga

SEQ ID NO: 81819 - RNA, 1410 nt, Artificial Sequence
  derived and/or modified sequence opt1 from neuraminidase__InfluenzaA__AEI87087
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccgaucagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucuggguggagcucauccggggccgccccaaggagaacaccaucuggaccagcggguccaucaucagcuucugcuccgucaacagcgacaccgugggcugguccuggcccgacggggccgagcugccguucacgaucgacaaguga

SEQ ID NO: 81820 - RNA, 1410 nt, Artificial Sequence; identical to SEQ ID NO: 81791
  derived and/or modified sequence opt1 from neuraminidase__InfluenzaA__AEI87097

SEQ ID NO: 81821 - RNA, 1410 nt, Artificial Sequence; identical to SEQ ID NO: 81791
  derived and/or modified sequence opt1 from neuraminidase__InfluenzaA__AEI87107

SEQ ID NO: 81822 - RNA, 1413 nt, Artificial Sequence
  derived and/or modified sequence opt1 from neuraminidase__InfluenzaA__AEI91968
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcaucaagcccugcuucugggucgagcuggugcgggggcucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 81823 - RNA, 1410 nt, Artificial Sequence; identical to SEQ ID NO: 77746
  derived and/or modified sequence opt1 from neuraminidase__InfluenzaA__AEI91983

SEQ ID NO: 81824 - RNA, 1410 nt, Artificial Sequence; identical to SEQ ID NO: 80232
  derived and/or modified sequence opt1 from neuraminidase__InfluenzaA__AEI91984

SEQ ID NO: 81825 - RNA, 1410 nt, Artificial Sequence
  derived and/or modified sequence opt1 from neuraminidase__InfluenzaA__AEI92004
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccuacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81826 - RNA, 1413 nt, Artificial Sequence
  derived and/or modified sequence opt1 from neuraminidase__InfluenzaA__AEI92023
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagaagaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgucaaggaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgcgacaacuggcacgggagcaaccggcccuggguguccuucaaccagaaccuggacuaccagaucggcuacaucugcagcggcgucuucggggacaacccccgccccgaggacggcgagggguccugcaacccggugaccguggacggcacgaacggggucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggcgaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 81827 - RNA, 1410 nt, Artificial Sequence
  derived and/or modified sequence opt1 from neuraminidase__InfluenzaA__AEJ10403
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcgccaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 81828 - RNA, 1410 nt, Artificial Sequence; identical to SEQ ID NO: 81794
  derived and/or modified sequence opt1 from neuraminidase__InfluenzaA__AEJ10413

SEQ ID NO: 81829 - RNA, 1410 nt, Artificial Sequence; identical to SEQ ID NO: 81816
  derived and/or modified sequence opt1 from neuraminidase__InfluenzaA__AEJ10423

SEQ ID NO: 81830 - RNA, 1410 nt, Artificial Sequence
  derived and/or modified sequence opt1 from neuraminidase__InfluenzaA__AEJ10433
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgggaccgugggcugguccuggcccgacggcgccgagcugccguucacgaucgacaaguga

SEQ ID NO: 81831 - RNA, 1410 nt, Artificial Sequence; identical to SEQ ID NO: 81265
  derived and/or modified sequence opt1 from neuraminidase__InfluenzaA__AEJ10443

SEQ ID NO: 81832 - RNA, 1410 nt, Artificial Sequence; identical to SEQ ID NO: 81265
  derived and/or modified sequence opt1 from neuraminidase__InfluenzaA__AEJ10453

SEQ ID NO: 81833 - RNA, 1410 nt, Artificial Sequence; identical to SEQ ID NO: 81717
  derived and/or modified sequence opt1 from neuraminidase__InfluenzaA__AEJ10463

SEQ ID NO: 81834 - RNA, 1410 nt, Artificial Sequence
  derived and/or modified sequence opt1 from neuraminidase__InfluenzaA__AEJ10473
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81835 - RNA, 1410 nt, Artificial Sequence; identical to SEQ ID NO: 81265
  derived and/or modified sequence opt1 from neuraminidase__InfluenzaA__AEJ10503

SEQ ID NO: 81836 - RNA, 1410 nt, Artificial Sequence; identical to SEQ ID NO: 77746
  derived and/or modified sequence opt1 from neuraminidase__InfluenzaA__AEJ10523

SEQ ID NO: 81837 - RNA, 1410 nt, Artificial Sequence; identical to SEQ ID NO: 77746
  derived and/or modified sequence opt1 from neuraminidase__InfluenzaA__AEJ10533

SEQ ID NO: 81838 - RNA, 1410 nt, Artificial Sequence; identical to SEQ ID NO: 77746
  derived and/or modified sequence opt1 from neuraminidase__InfluenzaA__AEJ10543

SEQ ID NO: 81839 - RNA, 1410 nt, Artificial Sequence; identical to SEQ ID NO: 77746
  derived and/or modified sequence opt1 from neuraminidase__InfluenzaA__AEJ10553

SEQ ID NO: 81840 - RNA, 1410 nt, Artificial Sequence; identical to SEQ ID NO: 80021
  derived and/or modified sequence opt1 from neuraminidase__InfluenzaA__AEJ10563

SEQ ID NO: 81841 - RNA, 1410 nt, Artificial Sequence; identical to SEQ ID NO: 80021
  derived and/or modified sequence opt1 from neuraminidase__InfluenzaA__AEJ10573

SEQ ID NO: 81842 - RNA, 1410 nt, Artificial Sequence; identical to SEQ ID NO: 80021
  derived and/or modified sequence opt1 from neuraminidase__InfluenzaA__AEJ10583

SEQ ID NO: 81843 - RNA, 1410 nt, Artificial Sequence
  derived and/or modified sequence opt1 from neuraminidase__InfluenzaA__AEJ36305
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaccagcucccggaacggcuucgagaugaucugggaccccaacggguggaccggcacggacaacagcuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 81844 - RNA, 1410 nt, Artificial Sequence; identical to SEQ ID NO: 77746
  derived and/or modified sequence opt1 from neuraminidase__InfluenzaA__AEJ37856

SEQ ID NO: 81845 - RNA, 1410 nt, Artificial Sequence; identical to SEQ ID NO: 77746
  derived and/or modified sequence opt1 from neuraminidase__InfluenzaA__AEJ37866

SEQ ID NO: 81846 - RNA, 1410 nt, Artificial Sequence; identical to SEQ ID NO: 77746
  derived and/or modified sequence opt1 from neuraminidase__InfluenzaA__AEJ37876

SEQ ID NO: 81847 - RNA, 1410 nt, Artificial Sequence; identical to SEQ ID NO: 81794
  derived and/or modified sequence opt1 from neuraminidase__InfluenzaA__AEJ37886

SEQ ID NO: 81848 - RNA, 1410 nt, Artificial Sequence
  derived and/or modified sequence opt1 from neuraminidase__InfluenzaA__AEJ37896
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggcggaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 81849 - RNA, 1410 nt, Artificial Sequence; identical to SEQ ID NO: 81794
  derived and/or modified sequence opt1 from neuraminidase__InfluenzaA__AEJ37906

SEQ ID NO: 81850 - RNA, 1410 nt, Artificial Sequence; identical to SEQ ID NO: 81794
  derived and/or modified sequence opt1 from neuraminidase__InfluenzaA__AEJ37916

SEQ ID NO: 81851 - RNA, 1410 nt, Artificial Sequence; identical to SEQ ID NO: 81794
  derived and/or modified sequence opt1 from neuraminidase__InfluenzaA__AEJ37926

SEQ ID NO: 81852 - RNA, 1410 nt, Artificial Sequence; identical to SEQ ID NO: 79648
  derived and/or modified sequence opt1 from neuraminidase__InfluenzaA__AEJ37936

SEQ ID NO: 81853 - RNA, 1410 nt, Artificial Sequence; identical to SEQ ID NO: 77746
  derived and/or modified sequence opt1 from neuraminidase__InfluenzaA__AEJ37946

SEQ ID NO: 81854 - RNA, 1410 nt, Artificial Sequence; identical to SEQ ID NO: 81794
  derived and/or modified sequence opt1 from neuraminidase__InfluenzaA__AEJ37956

SEQ ID NO: 81855 - RNA, 1410 nt, Artificial Sequence; identical to SEQ ID NO: 81794
  derived and/or modified sequence opt1 from neuraminidase__InfluenzaA__AEJ37966

SEQ ID NO: 81856 - RNA, 1410 nt, Artificial Sequence; identical to SEQ ID NO: 77746
  derived and/or modified sequence opt1 from neuraminidase__InfluenzaA__AEJ37976

SEQ ID NO: 81857 - RNA, 1410 nt, Artificial Sequence; identical to SEQ ID NO: 81794
  derived and/or modified sequence opt1 from neuraminidase__InfluenzaA__AEJ37986

SEQ ID NO: 81858 - RNA, 1410 nt, Artificial Sequence; identical to SEQ ID NO: 80418
  derived and/or modified sequence opt1 from neuraminidase__InfluenzaA__AEK21372

SEQ ID NO: 81859 - RNA, 1413 nt, Artificial Sequence; identical to SEQ ID NO: 81212
  derived and/or modified sequence opt1 from neuraminidase__InfluenzaA__AEK21383

SEQ ID NO: 81860 - RNA, 1410 nt, Artificial Sequence; identical to SEQ ID NO: 79648
  derived and/or modified sequence opt1 from neuraminidase__InfluenzaA__AEK21399

SEQ ID NO: 81861 - RNA, 1410 nt, Artificial Sequence; identical to SEQ ID NO: 77746
  derived and/or modified sequence opt1 from neuraminidase__InfluenzaA__AEK21409

SEQ ID NO: 81862 - RNA, 1410 nt, Artificial Sequence; identical to SEQ ID NO: 81717
  derived and/or modified sequence opt1 from neuraminidase__InfluenzaA__AEK21419

SEQ ID NO: 81863 - RNA, 1410 nt, Artificial Sequence; identical to SEQ ID NO: 81794
  derived and/or modified sequence opt1 from neuraminidase__InfluenzaA__AEK21429

SEQ ID NO: 81864 - RNA, 1410 nt, Artificial Sequence
  derived and/or modified sequence opt1 from neuraminidase__InfluenzaA__AEK21439
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81865 - RNA, 1410 nt, Artificial Sequence; identical to SEQ ID NO: 81794
  derived and/or modified sequence opt1 from neuraminidase__InfluenzaA__AEK21449

SEQ ID NO: 81866 - RNA, 1410 nt, Artificial Sequence; identical to SEQ ID NO: 79648
  derived and/or modified sequence opt1 from neuraminidase__InfluenzaA__AEK21459

SEQ ID NO: 81867 - RNA, 1410 nt, Artificial Sequence; identical to SEQ ID NO: 81794
  derived and/or modified sequence opt1 from neuraminidase__InfluenzaA__AEK21469

SEQ ID NO: 81868 - RNA, 1410 nt, Artificial Sequence; identical to SEQ ID NO: 81794
  derived and/or modified sequence opt1 from neuraminidase__InfluenzaA__AEK21479

SEQ ID NO: 81869 - RNA, 1410 nt, Artificial Sequence; identical to SEQ ID NO: 77746
  derived and/or modified sequence opt1 from neuraminidase__InfluenzaA__AEK21489

SEQ ID NO: 81870 - RNA, 1410 nt, Artificial Sequence; identical to SEQ ID NO: 81462
  derived and/or modified sequence opt1 from neuraminidase__InfluenzaA__AEK28776

SEQ ID NO: 81871 - RNA, 1410 nt, Artificial Sequence
  derived and/or modified sequence opt1 from neuraminidase__InfluenzaA__AEK28787
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgaggggcggagcugcaucaaccgcugcuucuacguggagcucauccggggccgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 81872 - RNA, 1410 nt, Artificial Sequence
  derived and/or modified sequence opt1 from neuraminidase__InfluenzaA__AEK28798
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacgggaacgccuccggcaaggccgacaccaagauccucuucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugcuccgaccccaacaacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 81873 - RNA, 1410 nt, Artificial Sequence
  derived and/or modified sequence opt1 from neuraminidase__InfluenzaA__AEK28809
augaaccccaaccagaagaucaucaccaucggcagcgugucccugaccaucagcacgaucugcuucuucaugcagaucgccauccucaucaccaccgucaccgugcacuucaagcaguacgaguucaacuccccgcccaacaaccaggugaugcugugcgagcccacgaucaucgagcgcaacaucaccgagaucgucuaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccugggccaggggaccacgcucaacaacguccacuccaacaacaaggugcgcgaccggaccccguaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccgucgugagcugguccaaggagauccugcgcacccaggagagcgagugcgugugcaucaacgggaccugcacggucgugaugaccgacggguccgccagcggcaaggccgacaccaagauccuguucaucgaggagggcaagaucgugcacaccagcacgcucuccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccuggaccccaacaacgaggagggcggccacggggugaagggcugggccuucgacgacgggaacgacgucuggaugggccgcaccaucagcgagaagucccggcucggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcugauccgcgggcggaaggaggagaccgagguccucuggaccuccaacagcaucgugguguucugcggcaccuccgggaccuacggcacggggagcuggccggacggcgccgacaucaaccugaugcccaucuga

SEQ ID NO: 81874 - RNA, 1410 nt, Artificial Sequence
  derived and/or modified sequence opt1 from neuraminidase__InfluenzaA__AEK28819
augaaccccaaccagaagaucaucaccaucggcagcgugucccugaccaucagcacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgagcggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 81875 - RNA, 1410 nt, Artificial Sequence
  derived and/or modified sequence opt1 from neuraminidase__InfluenzaA__AEK28830
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaaccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 81876 - RNA, 1410 nt, Artificial Sequence
  derived and/or modified sequence opt1 from neuraminidase__InfluenzaA__AEK28841
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacggugaacaacguccacuccaacaacaccgugcgcggccggaccccguaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguaccccggggugcgcugcgugugccgggacaacuggaagggcagcaaccgcccgaucgucgacaucaacaucaaggaccacuccaucgugagcuccuacgugugcagcggccuggucggggacacgccccggaagaacgacuccagcuccagcucccacugccuggaccccaacaacgaggagggcgggcacggcgugaaggggugggccuucgacgacggcaacgacgucuggaugggccgcaccaucagcgagaagucccggcucggguacgagaccuucaaggugaucgagggcuggagcaaccacaaguccaagcugcagaucaaccgccaggugaucgucgaccgggggaaccgcagcggcuacuccgggaucuucagcguggagggcaagagcugcaucaaccggugcuucuacguggagcugauccgcggccggaaggaggagaccgagguccucuggaccuccaacagcaucgugguguucugcgggaccuccggcacguacgggaccggcagcuggcccgacggggccgaccugaaccugaugccgaucuga

SEQ ID NO: 81877 - RNA, 1410 nt, Artificial Sequence
  derived and/or modified sequence opt1 from neuraminidase__InfluenzaA__AEK28852
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaaccggguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 81878 - RNA, 1410 nt, Artificial Sequence; identical to SEQ ID NO: 79492
  derived and/or modified sequence opt1 from neuraminidase__InfluenzaA__AEK28863

SEQ ID NO: 81879 - RNA, 1410 nt, Artificial Sequence
  derived and/or modified sequence opt1 from neuraminidase__InfluenzaA__AEK28874
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 81880 - RNA, 1410 nt, Artificial Sequence
  derived and/or modified sequence opt1 from neuraminidase__InfluenzaA__AEK28885
augaaccccaaccagaagaucaucaccaucggcagcgugucccugaccaucagcacgaucugcuucuucaugcagaucgccauccucaucaccaccgucacccugcacuucaagcaguacgaguucaaccugccgcccaacaaccaggugaugcucugcgagcccacgaucaucgagcgcaacaucaccgagaucguguaccugaccaacaccacgaucgagaaggagaucugccccaagcuggccgaguaccggaacugguccaagccgcagugcgacaucaccggguucgcgcccuucagcaaggacaacuccauccgccucagcgccggcggggacaucugggucacccgggagcccuacguguccugcgaccccgacaagugcuaccaguucgcccugggccaggggaccacgcugaacaacgugcacagcaacaacaccguccgcgaccggaccccguaccgcacccuccugaugaacgagcugggcgugcccuuccaccucggcacgaagcaggucugcaucgccugguccagcuccagcugccacgacgggaaggccuggcugcacgugugcaucaccggcgacgacaagaacgcgaccgccuccuucaucuacaacgggcggcugguggacagcguggucuccuggagcaaggagauccuccgcacccaggaguccgagugcgugugcaucaacggcacgugcaccguggucaugaccgacgggagcgccuccggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccucgugggcgacacgccccggaagaacgacagcuccagcuccagccacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 81881 - RNA, 1410 nt, Artificial Sequence; identical to SEQ ID NO: 79617
  derived and/or modified sequence opt1 from neuraminidase__InfluenzaA__AEK28896

SEQ ID NO: 81882 - RNA, 1410 nt, Artificial Sequence
  derived and/or modified sequence opt1 from neuraminidase__InfluenzaA__AEK28907
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugcccccgccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 81883 - RNA, 1410 nt, Artificial Sequence; identical to SEQ ID NO: 77607
  derived and/or modified sequence opt1 from neuraminidase__InfluenzaA__AEK28918

SEQ ID NO: 81884 - RNA, 1410 nt, Artificial Sequence; identical to SEQ ID NO: 78913
  derived and/or modified sequence opt1 from neuraminidase__InfluenzaA__AEK28929

SEQ ID NO: 81885 - RNA, 1410 nt, Artificial Sequence
  derived and/or modified sequence opt1 from neuraminidase__InfluenzaA__AEK28951
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccacaagagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggcccucuggaccagcaacuccaucguggucuucugcggcaccagcgggacguacggcaccggguccuggcccgacggcgccgaccugaaccugaugccgaucuga

SEQ ID NO: 81886 - RNA, 1410 nt, Artificial Sequence
  derived and/or modified sequence opt1 from neuraminidase__InfluenzaA__AEK28962
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccccaccaacaccacgaucgagaaggagaucugcccgaagcucgccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggagcaacccgaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugcccaucuga

SEQ ID NO: 81887 - RNA, 1410 nt, Artificial Sequence
  derived and/or modified sequence opt1 from neuraminidase__InfluenzaA__AEK28973
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaacuucaugccgaucuga

SEQ ID NO: 81888 - RNA, 1410 nt, Artificial Sequence
  derived and/or modified sequence opt1 from neuraminidase__InfluenzaA__AEK28984
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcguccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 81889 - RNA, 1410 nt, Artificial Sequence; identical to SEQ ID NO: 81888
  derived and/or modified sequence opt1 from neuraminidase__InfluenzaA__AEK28995

SEQ ID NO: 81890 - RNA, 1410 nt, Artificial Sequence; identical to SEQ ID NO: 80526
  derived and/or modified sequence opt1 from neuraminidase__InfluenzaA__AEK29006

SEQ ID NO: 81891 - RNA, 1410 nt, Artificial Sequence
  derived and/or modified sequence opt1 from neuraminidase__InfluenzaA__AEK29028
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 81892 - RNA, 1410 nt, Artificial Sequence
  derived and/or modified sequence opt1 from neuraminidase__InfluenzaA__AEK29050
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaacccgaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcacguccgggaccuacggcaccgggagcuggcccgacggcgccgaccugaaccucaugcccaucuga

SEQ ID NO: 81893 - RNA, 1410 nt, Artificial Sequence
  derived and/or modified sequence opt1 from neuraminidase__InfluenzaA__AEK29061
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaucguccgggaccgcaccccguaccggacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcgccugguggacuccguggucagcugguccaaggagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 81894 - RNA, 1410 nt, Artificial Sequence
  derived and/or modified sequence opt1 from neuraminidase__InfluenzaA__AEK29083
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 81895 - RNA, 1410 nt, Artificial Sequence; identical to SEQ ID NO: 80418
  derived and/or modified sequence opt1 from neuraminidase__InfluenzaA__AEK29094

SEQ ID NO: 81896 - RNA, 1410 nt, Artificial Sequence; identical to SEQ ID NO: 80526
  derived and/or modified sequence opt1 from neuraminidase__InfluenzaA__AEK29127

SEQ ID NO: 81897 - RNA, 1410 nt, Artificial Sequence; identical to SEQ ID NO: 80526
  derived and/or modified sequence opt1 from neuraminidase__InfluenzaA__AEK29138

SEQ ID NO: 81898 - RNA, 1410 nt, Artificial Sequence
  derived and/or modified sequence opt1 from neuraminidase__InfluenzaA__AEK29182
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccaggugaaccgccaggugaucgucgaccggggcaaccgcuccggguacagcggcaucuucuccguggagggcaagagcugcaucaaccggugcuucuacguggagcugauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 81899 - RNA, 1410 nt, Artificial Sequence
  derived and/or modified sequence opt1 from neuraminidase__InfluenzaA__AEK29204
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccaacaccaagguccucuucaucgaggagggcaagaucgugcacacgagcacccuguccgggagcgcgcagcacguggaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 81900 - RNA, 1410 nt, Artificial Sequence
  derived and/or modified sequence opt1 from neuraminidase__InfluenzaA__AEK29215
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 81901 - RNA, 1410 nt, Artificial Sequence; identical to SEQ ID NO: 81899
  derived and/or modified sequence opt1 from neuraminidase__InfluenzaA__AEK29237

SEQ ID NO: 81902 - RNA, 1410 nt, Artificial Sequence; identical to SEQ ID NO: 80526
  derived and/or modified sequence opt1 from neuraminidase__InfluenzaA__AEK29248

SEQ ID NO: 81903 - RNA, 1410 nt, Artificial Sequence; identical to SEQ ID NO: 80526
  derived and/or modified sequence opt1 from neuraminidase__InfluenzaA__AEK29259

SEQ ID NO: 81904 - RNA, 1410 nt, Artificial Sequence; identical to SEQ ID NO: 80526
  derived and/or modified sequence opt1 from neuraminidase__InfluenzaA__AEK29270

SEQ ID NO: 81905 - RNA, 1413 nt, Artificial Sequence
  derived and/or modified sequence opt1 from neuraminidase__InfluenzaA__AEK59839
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggccucggcuggcugaccaucgggaucagcggccccgacaacggggcgguggccguccugaaguacaacggcaucaucacgggcaccaucaaguccuggaagaagcagauccuccgcacccaggagagcgagugcgugugcaugaacggguccugcuucaccaucaugacggacggccccagcaacggggccgccuccuacaagaucuucaagaucgagaagggcaaggugaccaagagcaucgagcugaacgcccccaacuuccacuacgaggagugcuccugcuacccggacaccgggaucgucaugugcgugugccgggacaacuggcacggcagcaaccgccccuggguguccuucaaccagaaccuggacuaccagaucggcuacaucugcagcggggucuucggcgacaacccccggcccaaggacggggagggcuccugcaacccggugaccguggacggggcggacggcgucaagggcuucagcuacaaguacgacaacgggguguggaucggccgcacgaaguccaaccggcuccgcaagggguucgagaugaucugggaccccaacggcuggaccaacaccgacagcgacuucuccgugaagcaggacgucguggccaucaccgacuggagcggguacagcggcuccuucgugcagcaccccgagcugacgggccuggacugcauccggcccugcuucugggucgagcucgugcgcgggcugccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 81906 - RNA, 1410 nt, Artificial Sequence
  derived and/or modified sequence opt1 from neuraminidase__InfluenzaA__AEK98375
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaccaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 81907 - RNA, 1410 nt, Artificial Sequence; identical to SEQ ID NO: 77607
  derived and/or modified sequence opt1 from neuraminidase__InfluenzaA__AEK98377

SEQ ID NO: 81908 - RNA, 1410 nt, Artificial Sequence; identical to SEQ ID NO: 77049
  derived and/or modified sequence opt1 from neuraminidase__InfluenzaA__AEK98379

SEQ ID NO: 81909 - RNA, 1410 nt, Artificial Sequence
  derived and/or modified sequence opt1 from neuraminidase__InfluenzaA__AEK98381
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacggggaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 81910 - RNA, 1410 nt, Artificial Sequence; identical to SEQ ID NO: 77049
  derived and/or modified sequence opt1 from neuraminidase__InfluenzaA__AEK98383

SEQ ID NO: 81911 - RNA, 1410 nt, Artificial Sequence; identical to SEQ ID NO: 77607
  derived and/or modified sequence opt1 from neuraminidase__InfluenzaA__AEK98385

SEQ ID NO: 81912 - RNA, 1410 nt, Artificial Sequence
  derived and/or modified sequence opt1 from neuraminidase__InfluenzaA__AEK98387
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugaucgacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaaccucaugcccaucuga

SEQ ID NO: 81913 - RNA, 1410 nt, Artificial Sequence; identical to SEQ ID NO: 77607
  derived and/or modified sequence opt1 from neuraminidase__InfluenzaA__AEK98389

SEQ ID NO: 81914 - RNA, 1410 nt, Artificial Sequence
  derived and/or modified sequence opt1 from neuraminidase__InfluenzaA__AEK98393
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgccagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaaccucaugcccaucuga

SEQ ID NO: 81915 - RNA, 1410 nt, Artificial Sequence; identical to SEQ ID NO: 80526
  derived and/or modified sequence opt1 from neuraminidase__InfluenzaA__AEK98395

SEQ ID NO: 81916 - RNA, 1410 nt, Artificial Sequence
  derived and/or modified sequence opt1 from neuraminidase__InfluenzaA__AEK98397
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacuucaugcccaucuga

SEQ ID NO: 81917 - RNA, 1410 nt, Artificial Sequence; identical to SEQ ID NO: 77607
  derived and/or modified sequence opt1 from neuraminidase__InfluenzaA__AEK98399

SEQ ID NO: 81918 - RNA, 1410 nt, Artificial Sequence; identical to SEQ ID NO: 77520
  derived and/or modified sequence opt1 from neuraminidase__InfluenzaA__AEK98403

SEQ ID NO: 81919 - RNA, 1410 nt, Artificial Sequence
  derived and/or modified sequence opt1 from neuraminidase__InfluenzaA__AEK98405
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccgggacaaccgcagcggcuacuccgggaucuucagcguggagggcaagagcugcaucaaccggugcuucuacgucgagcucauccgcgggcggaaggaggagaccgaggugcuguggaccuccaacagcaucguggucuucugcggcaccuccggcacguacgggaccggcagcuggccggacggggccgacaucaaccugaugcccaucuga

SEQ ID NO: 81920 - RNA, 1410 nt, Artificial Sequence
  derived and/or modified sequence opt1 from neuraminidase__InfluenzaA__AEK98407
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgugcggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccgggacaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 81921 - RNA, 1410 nt, Artificial Sequence; identical to SEQ ID NO: 75335
  derived and/or modified sequence opt1 from neuraminidase__InfluenzaA__AEL11690

SEQ ID NO: 81922 - RNA, 1410 nt, Artificial Sequence; identical to SEQ ID NO: 80021
  derived and/or modified sequence opt1 from neuraminidase__InfluenzaA__AEL89300

SEQ ID NO: 81923 - RNA, 1410 nt, Artificial Sequence; identical to SEQ ID NO: 80021
  derived and/or modified sequence opt1 from neuraminidase__InfluenzaA__AEL89310

SEQ ID NO: 81924 - RNA, 1410 nt, Artificial Sequence; identical to SEQ ID NO: 80021
  derived and/or modified sequence opt1 from neuraminidase__InfluenzaA__AEL89320

SEQ ID NO: 81925 - RNA, 1410 nt, Artificial Sequence; identical to SEQ ID NO: 80021
  derived and/or modified sequence opt1 from neuraminidase__InfluenzaA__AEL89330

SEQ ID NO: 81926 - RNA, 1410 nt, Artificial Sequence; identical to SEQ ID NO: 80021
  derived and/or modified sequence opt1 from neuraminidase__InfluenzaA__AEL89340

SEQ ID NO: 81927 - RNA, 1410 nt, Artificial Sequence; identical to SEQ ID NO: 80021
  derived and/or modified sequence opt1 from neuraminidase__InfluenzaA__AEL89350

SEQ ID NO: 81928 - RNA, 1410 nt, Artificial Sequence; identical to SEQ ID NO: 80021
  derived and/or modified sequence opt1 from neuraminidase__InfluenzaA__AEL89360

SEQ ID NO: 81929 - RNA, 1410 nt, Artificial Sequence; identical to SEQ ID NO: 80021
  derived and/or modified sequence opt1 from neuraminidase__InfluenzaA__AEL89370

SEQ ID NO: 81930 - RNA, 1410 nt, Artificial Sequence; identical to SEQ ID NO: 80021
  derived and/or modified sequence opt1 from neuraminidase__InfluenzaA__AEL89394

SEQ ID NO: 81931 - RNA, 1410 nt, Artificial Sequence; identical to SEQ ID NO: 80021
  derived and/or modified sequence opt1 from neuraminidase__InfluenzaA__AEL89404

SEQ ID NO: 81932 - RNA, 1410 nt, Artificial Sequence; identical to SEQ ID NO: 80021
  derived and/or modified sequence opt1 from neuraminidase__InfluenzaA__AEL89414

SEQ ID NO: 81933 - RNA, 1410 nt, Artificial Sequence; identical to SEQ ID NO: 80021
  derived and/or modified sequence opt1 from neuraminidase__InfluenzaA__AEL89424

SEQ ID NO: 81934 - RNA, 1410 nt, Artificial Sequence; identical to SEQ ID NO: 80021
  derived and/or modified sequence opt1 from neuraminidase__InfluenzaA__AEL89434

SEQ ID NO: 81935 - RNA, 1410 nt, Artificial Sequence; identical to SEQ ID NO: 80021
  derived and/or modified sequence opt1 from neuraminidase__InfluenzaA__AEL89444

SEQ ID NO: 81936 - RNA, 1410 nt, Artificial Sequence; identical to SEQ ID NO: 80021
  derived and/or modified sequence opt1 from neuraminidase__InfluenzaA__AEL89454

SEQ ID NO: 81937 - RNA, 1410 nt, Artificial Sequence; identical to SEQ ID NO: 80021
  derived and/or modified sequence opt1 from neuraminidase__InfluenzaA__AEL89464

SEQ ID NO: 81938 - RNA, 1410 nt, Artificial Sequence; identical to SEQ ID NO: 80021
  derived and/or modified sequence opt1 from neuraminidase__InfluenzaA__AEL89474

SEQ ID NO: 81939 - RNA, 1410 nt, Artificial Sequence
  derived and/or modified sequence opt1 from neuraminidase__InfluenzaA__AEL89484
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81940 - RNA, 1410 nt, Artificial Sequence; identical to SEQ ID NO: 81810
  derived and/or modified sequence opt1 from neuraminidase__InfluenzaA__AEL89494

SEQ ID NO: 81941 - RNA, 1410 nt, Artificial Sequence; identical to SEQ ID NO: 81816
  derived and/or modified sequence opt1 from neuraminidase__InfluenzaA__AEL89514

SEQ ID NO: 81942 - RNA, 1410 nt, Artificial Sequence; identical to SEQ ID NO: 81794
  derived and/or modified sequence opt1 from neuraminidase__InfluenzaA__AEL89524

SEQ ID NO: 81943 - RNA, 1410 nt, Artificial Sequence
  derived and/or modified sequence opt1 from neuraminidase__InfluenzaA__AEL89534
augaaccccaaccagaagaucaucaccaucggcagcgugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaucaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaagaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 81944 - RNA, 1410 nt, Artificial Sequence; identical to SEQ ID NO: 81816
  derived and/or modified sequence opt1 from neuraminidase__InfluenzaA__AEL89544

SEQ ID NO: 81945 - RNA, 1410 nt, Artificial Sequence; identical to SEQ ID NO: 81816
  derived and/or modified sequence opt1 from neuraminidase__InfluenzaA__AEL89554

SEQ ID NO: 81946 - RNA, 1410 nt, Artificial Sequence
  derived and/or modified sequence opt1 from neuraminidase__InfluenzaA__AEL89564
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgagagcguggccugguccgcgagcgccugccacgacgggaucuccuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81947 - RNA, 1410 nt, Artificial Sequence; identical to SEQ ID NO: 81816
  derived and/or modified sequence opt1 from neuraminidase__InfluenzaA__AEL89574

SEQ ID NO: 81948 - RNA, 1410 nt, Artificial Sequence; identical to SEQ ID NO: 81816
  derived and/or modified sequence opt1 from neuraminidase__InfluenzaA__AEL89584

SEQ ID NO: 81949 - RNA, 1410 nt, Artificial Sequence; identical to SEQ ID NO: 78763
  derived and/or modified sequence opt1 from neuraminidase__InfluenzaA__AEL89604

SEQ ID NO: 81950 - RNA, 1410 nt, Artificial Sequence; identical to SEQ ID NO: 81265
  derived and/or modified sequence opt1 from neuraminidase__InfluenzaA__AEL89624

SEQ ID NO: 81951 - RNA, 1410 nt, Artificial Sequence
  derived and/or modified sequence opt1 from neuraminidase__InfluenzaA__AEL89634
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuacaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81952 - RNA, 1410 nt, Artificial Sequence; identical to SEQ ID NO: 80021
  derived and/or modified sequence opt1 from neuraminidase__InfluenzaA__AEL89644

SEQ ID NO: 81953 - RNA, 1410 nt, Artificial Sequence; identical to SEQ ID NO: 81717
  derived and/or modified sequence opt1 from neuraminidase__InfluenzaA__AEL89654

SEQ ID NO: 81954 - RNA, 1410 nt, Artificial Sequence; identical to SEQ ID NO: 81265
  derived and/or modified sequence opt1 from neuraminidase__InfluenzaA__AEL89664

SEQ ID NO: 81955 - RNA, 1410 nt, Artificial Sequence; identical to SEQ ID NO: 81265
  derived and/or modified sequence opt1 from neuraminidase__InfluenzaA__AEL89674

SEQ ID NO: 81956 - RNA, 1410 nt, Artificial Sequence; identical to SEQ ID NO: 81265
  derived and/or modified sequence opt1 from neuraminidase__InfluenzaA__AEL89694

SEQ ID NO: 81957 - RNA, 1410 nt, Artificial Sequence
  derived and/or modified sequence opt1 from neuraminidase__InfluenzaA__AEL89704
augaaccccaaccagaagaucaucaccaucggcagcgugugcaugaccaucgggauggccaaccugauccuccagaucggcaacaucauccugaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgaacgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucuccagccggaacggcuucgagaugaucugggaccccaacggguggaccggcaccgacaacaacuucagcgugaagcaggacaucaucgggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81958 - RNA, 1410 nt, Artificial Sequence; identical to SEQ ID NO: 81957
  derived and/or modified sequence opt1 from neuraminidase__InfluenzaA__AEL89714

SEQ ID NO: 81959 - RNA, 1410 nt, Artificial Sequence; identical to SEQ ID NO: 81265
  derived and/or modified sequence opt1 from neuraminidase__InfluenzaA__AEL89744

SEQ ID NO: 81960 - RNA, 1410 nt, Artificial Sequence
  derived and/or modified sequence opt1 from neuraminidase__InfluenzaA__AEL89754
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucaucaucgacaaguga

SEQ ID NO: 81961 - RNA, 1410 nt, Artificial Sequence; identical to SEQ ID NO: 80021
  derived and/or modified sequence opt1 from neuraminidase__InfluenzaA__AEL89774

SEQ ID NO: 81962 - RNA, 1410 nt, Artificial Sequence
  derived and/or modified sequence opt1 from neuraminidase__InfluenzaA__AEL89784
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagccugcggaacggcuucgagaugaucugggaccccaacggguggaccggcaccgacaacaacuucuccgugaagcaggacaucaucgggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81963 - RNA, 1410 nt, Artificial Sequence
  derived and/or modified sequence opt1 from neuraminidase__InfluenzaA__AEL89794
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacgccgugggguggagcuggcccgacggcgcggagcugccguucaccaucgacaaguga

SEQ ID NO: 81964 - RNA, 1410 nt, Artificial Sequence; identical to SEQ ID NO: 81717
  derived and/or modified sequence opt1 from neuraminidase__InfluenzaA__AEL89804

SEQ ID NO: 81965 - RNA, 1410 nt, Artificial Sequence
  derived and/or modified sequence opt1 from neuraminidase__InfluenzaA__AEL89815
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcgugaagcaggacaucaucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81966 - RNA, 1410 nt, Artificial Sequence
  derived and/or modified sequence opt1 from neuraminidase__InfluenzaA__AEL89825
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 81967 - RNA, 1410 nt, Artificial Sequence
  derived and/or modified sequence opt1 from neuraminidase__InfluenzaA__AEL89835
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgugugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81968 - RNA, 1410 nt, Artificial Sequence
  derived and/or modified sequence opt1 from neuraminidase__InfluenzaA__AEL89845
augaaccccaaccagaagaucaucaccaucggcagcgugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccaccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggcccccucccccuacaacagccgguucgagagcgucgccugguccgcgagcgccugccacgacgggaucaacuggcucaccaucggcaucuccggccccgacaacggggccguggccgugcugaaguacaacggcaucaucaccgacacgaucaagagcuggcgcaacaacauccugcggacccaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaagggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81969 - RNA, 1410 nt, Artificial Sequence; identical to SEQ ID NO: 81966
  derived and/or modified sequence opt1 from neuraminidase__InfluenzaA__AEL89855

SEQ ID NO: 81970 - RNA, 1410 nt, Artificial Sequence; identical to SEQ ID NO: 81265
  derived and/or modified sequence opt1 from neuraminidase__InfluenzaA__AEL93581

SEQ ID NO: 81971 - RNA, 1410 nt, Artificial Sequence
  derived and/or modified sequence opt1 from neuraminidase__InfluenzaA__AEL93591
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaccuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 81972 - RNA, 1410 nt, Artificial Sequence; identical to SEQ ID NO: 81717
  derived and/or modified sequence opt1 from neuraminidase__InfluenzaA__AEL93601

SEQ ID NO: 81973 - RNA, 1410 nt, Artificial Sequence; identical to SEQ ID NO: 81265
  derived and/or modified sequence opt1 from neuraminidase__InfluenzaA__AEL93611

SEQ ID NO: 81974 - RNA, 1410 nt, Artificial Sequence; identical to SEQ ID NO: 81265
  derived and/or modified sequence opt1 from neuraminidase__InfluenzaA__AEL93621

SEQ ID NO: 81975 - RNA, 1410 nt, Artificial Sequence; identical to SEQ ID NO: 81265
  derived and/or modified sequence opt1 from neuraminidase__InfluenzaA__AEL93631

SEQ ID NO: 81976 - RNA, 1410 nt, Artificial Sequence
  derived and/or modified sequence opt1 from neuraminidase__InfluenzaA__AEL93641
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccagcccaaggagaacaccaucuggaccuccgggagcuccaucagcuucugcggcgugaacuccgacaccgucggguggagcuggcccgacggcgccgagcugccguucacgaucgacaaguga

SEQ ID NO: 81977 - RNA, 1410 nt, Artificial Sequence; identical to SEQ ID NO: 81816
  derived and/or modified sequence opt1 from neuraminidase__InfluenzaA__AEL94890

SEQ ID NO: 81978 - RNA, 1410 nt, Artificial Sequence
  derived and/or modified sequence opt1 from neuraminidase__InfluenzaA__AEL95429
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccccaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 81979 - RNA, 1410 nt, Artificial Sequence
  derived and/or modified sequence opt1 from neuraminidase__InfluenzaA__AEL97634
augaaccccaaccagaagaucaucaccaucggcagcgugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgugggggucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 81980 - RNA, 1410 nt, Artificial Sequence; identical to SEQ ID NO: 77746
  derived and/or modified sequence opt1 from neuraminidase__InfluenzaA__AEL99667

SEQ ID NO: 81981 - RNA, 1410 nt, Artificial Sequence; identical to SEQ ID NO: 77746
  derived and/or modified sequence opt1 from neuraminidase__InfluenzaA__AEL99677

SEQ ID NO: 81982 - RNA, 1410 nt, Artificial Sequence; identical to SEQ ID NO: 76784
  derived and/or modified sequence opt1 from neuraminidase__InfluenzaA__AEM53471

SEQ ID NO: 81983 - RNA, 1413 nt, Artificial Sequence; identical to SEQ ID NO: 77461
  derived and/or modified sequence opt1 from neuraminidase__InfluenzaA__AEM60040

SEQ ID NO: 81984 - RNA, 1413 nt, Artificial Sequence; identical to SEQ ID NO: 77051
  derived and/or modified sequence opt1 from neuraminidase__InfluenzaA__AEM60061

SEQ ID NO: 81985 - RNA, 1410 nt, Artificial Sequence
  derived and/or modified sequence opt1 from neuraminidase__InfluenzaA__AEM60072
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcgagcaggagacgcgggucugguggaccuccaacagcaucgugguguucugcggcaccuccgggaccuacggcacggggagcuggcccgacggcgccgacaucaaccucaugcccaucuga

SEQ ID NO: 81986 - RNA, 1410 nt, Artificial Sequence; identical to SEQ ID NO: 77746
  derived and/or modified sequence opt1 from neuraminidase__InfluenzaA__AEM62774

SEQ ID NO: 81987 - RNA, 1410 nt, Artificial Sequence; identical to SEQ ID NO: 77746
  derived and/or modified sequence opt1 from neuraminidase__InfluenzaA__AEM62783

SEQ ID NO: 81988 - RNA, 1410 nt, Artificial Sequence
  derived and/or modified sequence opt1 from neuraminidase__InfluenzaA__AEM62792
augaaccccaaccagaagaucaucaccaucggcagcgugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucaucagcgugcgccuggccgggaacuccagccucugcccgguguccggcugggccaucuacagcaaggacaacuccauccggaucggcagcaagggggacgucuucgugauccgcgagcccuucaucuccugcagcccccuggagugccggaccuucuuccugacccagggcgcccuccugaacgacaagcacuccaacgggaccaucaaggaccgcagccccuaccggacgcugauguccugcccgaucggcgaggugcccagccccuacaacagccgcuucgaguccgucgccuggagcgcguccgccugccacgacgggaucaacuggcucaccaucggcaucagcggccccgacaacggggccguggccgugcugaaguacaacggcaucaucaccgacaccaucaaguccuggcggaacaacauccugcgcacgcaggagagcgagugcgcgugcgucaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaacggcuucgagaugaucugggaccccaacggguggaccggcaccgacaacaacuucuccaucaagcaggacaucaucgggaucaacgaguggagcggcuacuccgggagcuucguccagcacccggagcugacgggccuggacugcauccggcccugcuucuggguggagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 81989 - RNA, 1410 nt, Artificial Sequence; identical to SEQ ID NO: 77746
  derived and/or modified sequence opt1 from neuraminidase__InfluenzaA__AEM62801

SEQ ID NO: 81990 - RNA, 1410 nt, Artificial Sequence
  derived and/or modified sequence opt1 from neuraminidase__InfluenzaA__AEM62810
augaaccccaaccagaagaucaucaccaucggcagcgugugcaugaccaucgggaugggcaaccugauccuccagaucgggaacaucaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgccgggcagagcgucguguccgugaagcuggcgggcaacagcucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgccagcgcgugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgccugcgugaacggcagcugcuucaccgugaugaccgacggcccguccgacgggcaggcgagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 81991 - RNA, 1410 nt, Artificial Sequence
  derived and/or modified sequence opt1 from neuraminidase__InfluenzaA__AEM62819
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacgacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 81992 - RNA, 1410 nt, Artificial Sequence; identical to SEQ ID NO: 77746
  derived and/or modified sequence opt1 from neuraminidase__InfluenzaA__AEM62828

SEQ ID NO: 81993 - RNA, 1410 nt, Artificial Sequence; identical to SEQ ID NO: 78329
  derived and/or modified sequence opt1 from neuraminidase__InfluenzaA__AEM62837

SEQ ID NO: 81994 - RNA, 1410 nt, Artificial Sequence; identical to SEQ ID NO: 77746
  derived and/or modified sequence opt1 from neuraminidase__InfluenzaA__AEM62846

SEQ ID NO: 81995 - RNA, 1410 nt, Artificial Sequence
  derived and/or modified sequence opt1 from neuraminidase__InfluenzaA__AEM62855
augaaccccaaccagaagaucaucaccaucggcagcgugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 81996 - RNA, 1410 nt, Artificial Sequence
  derived and/or modified sequence opt1 from neuraminidase__InfluenzaA__AEM62864
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuucggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81997 - RNA, 1410 nt, Artificial Sequence
  derived and/or modified sequence opt1 from neuraminidase__InfluenzaA__AEM62872
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccuucaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 81998 - RNA, 1410 nt, Artificial Sequence; identical to SEQ ID NO: 77746
  derived and/or modified sequence opt1 from neuraminidase__InfluenzaA__AEM92310

SEQ ID NO: 81999 - RNA, 1410 nt, Artificial Sequence; identical to SEQ ID NO: 79208
  derived and/or modified sequence opt1 from neuraminidase__InfluenzaA__AEM92320

SEQ ID NO: 82000 - RNA, 1410 nt, Artificial Sequence
  derived and/or modified sequence opt1 from neuraminidase__InfluenzaA__AEM92340
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggacccgcaccgacaacaacuucagcaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 82001 - RNA, 1410 nt, Artificial Sequence; identical to SEQ ID NO: 79208
  derived and/or modified sequence opt1 from neuraminidase__InfluenzaA__AEM92350

SEQ ID NO: 82002 - RNA, 1410 nt, Artificial Sequence
  derived and/or modified sequence opt1 from neuraminidase__InfluenzaA__AEM92360
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaagggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 82003 - RNA, 1410 nt, Artificial Sequence; identical to SEQ ID NO: 82000
  derived and/or modified sequence opt1 from neuraminidase__InfluenzaA__AEM92370

SEQ ID NO: 82004 - RNA, 1410 nt, Artificial Sequence; identical to SEQ ID NO: 82000
  derived and/or modified sequence opt1 from neuraminidase__InfluenzaA__AEM92380

SEQ ID NO: 82005 - RNA, 1410 nt, Artificial Sequence
  derived and/or modified sequence opt1 from neuraminidase__InfluenzaA__AEM92399
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaccaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccucgacugcauccgccccugcuucugggucgagcugauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 82006 - RNA, 1410 nt, Artificial Sequence; identical to SEQ ID NO: 82005
  derived and/or modified sequence opt1 from neuraminidase__InfluenzaA__AEM92409

SEQ ID NO: 82007 - RNA, 1410 nt, Artificial Sequence; identical to SEQ ID NO: 78170
  derived and/or modified sequence opt1 from neuraminidase__InfluenzaA__AEM92419

SEQ ID NO: 82008 - RNA, 1410 nt, Artificial Sequence
  derived and/or modified sequence opt1 from neuraminidase__InfluenzaA__AEM92430
augaaccccaaccagaagaucaugaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82009 - RNA, 1410 nt, Artificial Sequence
  derived and/or modified sequence opt1 from neuraminidase__InfluenzaA__AEM92440
augaaccccaaccagaagaucaucaccaucggcagcgugugcaucaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaucgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 82010 - RNA, 1410 nt, Artificial Sequence; identical to SEQ ID NO: 81966
  derived and/or modified sequence opt1 from neuraminidase__InfluenzaA__AEM92450

SEQ ID NO: 82011 - RNA, 1410 nt, Artificial Sequence; identical to SEQ ID NO: 81966
  derived and/or modified sequence opt1 from neuraminidase__InfluenzaA__AEM92460

SEQ ID NO: 82012 - RNA, 1410 nt, Artificial Sequence; identical to SEQ ID NO: 81717
  derived and/or modified sequence opt1 from neuraminidase__InfluenzaA__AEM92470

SEQ ID NO: 82013 - RNA, 1410 nt, Artificial Sequence; identical to SEQ ID NO: 81717
  derived and/or modified sequence opt1 from neuraminidase__InfluenzaA__AEM92480

SEQ ID NO: 82014 - RNA, 1410 nt, Artificial Sequence
  derived and/or modified sequence opt1 from neuraminidase__InfluenzaA__AEM92490
augaaccccaaccagaagaucaucaccaucggcagcgugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 82015 - RNA, 1410 nt, Artificial Sequence
  derived and/or modified sequence opt1 from neuraminidase__InfluenzaA__AEM92500
augaaccccaaccagaagaucaucaccaucggcagcgugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaugggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 82016 - RNA, 1410 nt, Artificial Sequence
  derived and/or modified sequence opt1 from neuraminidase__InfluenzaA__AEM92520
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82017 - RNA, 1410 nt, Artificial Sequence; identical to SEQ ID NO: 81717
  derived and/or modified sequence opt1 from neuraminidase__InfluenzaA__AEM92550

SEQ ID NO: 82018 - RNA, 1410 nt, Artificial Sequence
  derived and/or modified sequence opt1 from neuraminidase__InfluenzaA__AEM92570
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaaggggaacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82019 - RNA, 1410 nt, Artificial Sequence
  derived and/or modified sequence opt1 from neuraminidase__InfluenzaA__AEM92580
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82020 - RNA, 1410 nt, Artificial Sequence; identical to SEQ ID NO: 81717
  derived and/or modified sequence opt1 from neuraminidase__InfluenzaA__AEM92590

SEQ ID NO: 82021 - RNA, 1410 nt, Artificial Sequence; identical to SEQ ID NO: 81717
  derived and/or modified sequence opt1 from neuraminidase__InfluenzaA__AEM92600

SEQ ID NO: 82022 - RNA, 1410 nt, Artificial Sequence
  derived and/or modified sequence opt1 from neuraminidase__InfluenzaA__AEM92610
augaaccccaaccagaagaucaucaccaucggcagcgugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucuccuggagcuggcccgacggggccgagcugccguucacgaucgacaaguga

SEQ ID NO: 82023 - RNA, 1410 nt, Artificial Sequence
  derived and/or modified sequence opt1 from neuraminidase__InfluenzaA__AEM92620
augaaccccaaccagaagaucaucaccaucggcagcgugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccuggacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaugggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 82024 - RNA, 1410 nt, Artificial Sequence
  derived and/or modified sequence opt1 from neuraminidase__InfluenzaA__AEM92650
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacacgaaguucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 82025 - RNA, 1410 nt, Artificial Sequence; identical to SEQ ID NO: 80418
  derived and/or modified sequence opt1 from neuraminidase__InfluenzaA__AEM98410

SEQ ID NO: 82026 - RNA, 1410 nt, Artificial Sequence; identical to SEQ ID NO: 80418
  derived and/or modified sequence opt1 from neuraminidase__InfluenzaA__AEM98421

SEQ ID NO: 82027 - RNA, 1410 nt, Artificial Sequence; identical to SEQ ID NO: 80418
  derived and/or modified sequence opt1 from neuraminidase__InfluenzaA__AEM98432

SEQ ID NO: 82028 - RNA, 1410 nt, Artificial Sequence; identical to SEQ ID NO: 81794
  derived and/or modified sequence opt1 from neuraminidase__InfluenzaA__AEN55401

SEQ ID NO: 82029 - RNA, 1410 nt, Artificial Sequence; identical to SEQ ID NO: 80021
  derived and/or modified sequence opt1 from neuraminidase__InfluenzaA__AEN55411

SEQ ID NO: 82030 - RNA, 1410 nt, Artificial Sequence
  derived and/or modified sequence opt1 from neuraminidase__InfluenzaA__AEN55421
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgugugcgugaacggcuccugcuucaccaucaugaccgacgggccgagcgacggccaggcguccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccugggucuccuucaaccagaaccucgaguaccagaucggcuacaucugcagcgggaucuucggcgacaacccgcgccccaacgacaagaccggguccugcggccccgugagcuccaacggcgccaacggggugaagggcuucagcuucaaguacgggaacggcgucuggaucgggcggaccaagagcaucuccagccgcaagggcuucgagaugaucugggaccccaacggcuggaccgggaccgacaacaacuucuccaucaagcaggacaucgugggcaucaacgaguggagcggguacuccggcagcuucgugcagcacccggagcugacggggcuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 82031 - RNA, 1410 nt, Artificial Sequence
  derived and/or modified sequence opt1 from neuraminidase__InfluenzaA__AEN55466
augaaccccaaccagaagaucaucaccaucggcagcgugugcaucaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcacggacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 82032 - RNA, 1410 nt, Artificial Sequence
  derived and/or modified sequence opt1 from neuraminidase__InfluenzaA__AEN55476
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugagcugguccuggcccgacggggccgagcugccguucacgaucgacaaguga

SEQ ID NO: 82033 - RNA, 1410 nt, Artificial Sequence; identical to SEQ ID NO: 81265
  derived and/or modified sequence opt1 from neuraminidase__InfluenzaA__AEN55486

SEQ ID NO: 82034 - RNA, 1410 nt, Artificial Sequence; identical to SEQ ID NO: 81265
  derived and/or modified sequence opt1 from neuraminidase__InfluenzaA__AEN55506

SEQ ID NO: 82035 - RNA, 1410 nt, Artificial Sequence
  derived and/or modified sequence opt1 from neuraminidase__InfluenzaA__AEN55516
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagccgcggggacguguucgugauccgggagcccuucaucuccugcagcccccuggagugccggaccuucuuccugacccagggcgcccuccugaacgacaagcacuccaacgggaccaucaaggaccgcagccccuaccggacgcugauguccugcccgaucggcgagguccccagccccuacaacagccgcuucgaguccguggccuggagcgcguccgccugccacgacgggaucaacuggcucaccaucggcaucagcggccccgacaacggggccguggccguccugaaguacaacggcaucaucaccgacaccaucaaguccuggcggaacaacauccugcgcacgcaggagagcgagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 82036 - RNA, 1410 nt, Artificial Sequence; identical to SEQ ID NO: 81265
  derived and/or modified sequence opt1 from neuraminidase__InfluenzaA__AEN55526

SEQ ID NO: 82037 - RNA, 1410 nt, Artificial Sequence; identical to SEQ ID NO: 81794
  derived and/or modified sequence opt1 from neuraminidase__InfluenzaA__AEN69429

SEQ ID NO: 82038 - RNA, 1410 nt, Artificial Sequence; identical to SEQ ID NO: 81791
  derived and/or modified sequence opt1 from neuraminidase__InfluenzaA__AEN69438

SEQ ID NO: 82039 - RNA, 1410 nt, Artificial Sequence; identical to SEQ ID NO: 80021
  derived and/or modified sequence opt1 from neuraminidase__InfluenzaA__AEN69484

SEQ ID NO: 82040 - RNA, 1410 nt, Artificial Sequence; identical to SEQ ID NO: 77693
  derived and/or modified sequence opt1 from neuraminidase__InfluenzaA__AEO01627

SEQ ID NO: 82041 - RNA, 1410 nt, Artificial Sequence; identical to SEQ ID NO: 77693
  derived and/or modified sequence opt1 from neuraminidase__InfluenzaA__AEO01638

SEQ ID NO: 82042 - RNA, 1410 nt, Artificial Sequence
  derived and/or modified sequence opt1 from neuraminidase__InfluenzaA__AEO01644
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaccgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgacaucaaccugaugcccaucuga

SEQ ID NO: 82043 - RNA, 1410 nt, Artificial Sequence
  derived and/or modified sequence opt1 from neuraminidase__InfluenzaA__AEO01654
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggacauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccaaggugcuguggaccagcaacuccaucguggucuucugcgggaccagcggcacguacgggaccggcuccuggccggacggggccgagaucaaccugaugcccaucuga

SEQ ID NO: 82044 - RNA, 1413 nt, Artificial Sequence; identical to SEQ ID NO: 77640
  derived and/or modified sequence opt1 from neuraminidase__InfluenzaA__AEO01665

SEQ ID NO: 82045 - RNA, 1413 nt, Artificial Sequence
  derived and/or modified sequence opt1 from neuraminidase__InfluenzaA__AEO01676
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuucuuccgcggcgacaacuccgacacggccaacuggagcuggcccgacggggccgagaugaccuucaccaucgacaaguga

SEQ ID NO: 82046 - RNA, 1410 nt, Artificial Sequence; identical to SEQ ID NO: 77693
  derived and/or modified sequence opt1 from neuraminidase__InfluenzaA__AEO01693

SEQ ID NO: 82047 - RNA, 1413 nt, Artificial Sequence; identical to SEQ ID NO: 77640
  derived and/or modified sequence opt1 from neuraminidase__InfluenzaA__AEO01711

SEQ ID NO: 82048 - RNA, 1410 nt, Artificial Sequence; identical to SEQ ID NO: 81816
  derived and/or modified sequence opt1 from neuraminidase__InfluenzaA__AEO37533

SEQ ID NO: 82049 - RNA, 1410 nt, Artificial Sequence
  derived and/or modified sequence opt1 from neuraminidase__InfluenzaA__AEO37543
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagccgugcaaccagagcgucaucacguacgagaacaacaccugggugaaccagaccuacgugaacaucuccaacaccaacuucgccgcgggccagagcgucguguccgugaagcuggccgggaacagcucccucugccccgucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccgguccccguaccgcacccugaugagcugccccaucggcgagguccccucccccuacaacagccgguucgagagcguggccugguccgcgagcgccugccacgacgggaucaacuggcucacgaucggcaucuccggcccggacaacggggccguggccguccugaaguacaacggcaucaucaccgacaccaucaagagcuggcgcaacaacauccugcggacccaggaguccgagugcgcgugcgugaacgggagcugcuucacggugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggacccgaacggguggaccggcaccgacaacaacuucagcgugaagcaggacaucaucgggaucaacgagugguccggcuacagcggguccuucgugcagcaccccgagcugaccggccuggacugcauccgccccugcuucugggucgagcucauccggggccgccccaaggagaacacgaucuggaccagcggguccagcaucuccuucugcggcgugaacagcgacaccgucgggugguccuggccggacggcgccgagcugcccuucaccaucgacaaguga

SEQ ID NO: 82050 - RNA, 1410 nt, Artificial Sequence; identical to SEQ ID NO: 81265
  derived and/or modified sequence opt1 from neuraminidase__InfluenzaA__AEO72179

SEQ ID NO: 82051 - RNA, 1350 nt, Artificial Sequence
  derived and/or modified sequence opt1 from neuraminidase__InfluenzaA__AEO88957
augaaccccaaccagaagaucaucaccaucggcagcaucugcauggugaucgggaucgucucccugaugcuccagaucggcaacaugaucagcaucugggugucccacagcacccagacggggaaccagcaccaggccgagccgauccgcaacaccaacuuccugaccgagaacgccguggcguccgucacccuggccggcaacagcucccucugccccauccgggggugggccgugcacagcaaggacaacuccauccgcaucggcagcaagggcgacguguucgucauccgggagcccuucaucuccugcagccaccuggagugccgcacguucuuccugacccagggggcccuccugaacgacaagcacuccaacggcaccgugaaggaccggagcccccaccgcacccugauguccugcccggugggggaggcccccagccccuacaacucccgguucgagagcgucgcgugguccgccagcgccugccacgacggcacgagcuggcucaccaucgggaucuccggccccgacaacggcgccguggcggugcugaaguacaacgggaucaucaccgacaccaucaagagcuggcgcaacaacauccugcggacgcaggaguccgagugcgccugcgucaacggcagcugcuucaccgugaugaccgacgggccguccaacggccaggccagcuacaagaucuucaagauggagaagggcaagguggucaaguccguggagcucaacgcccccaacuaccacuacgaggagugcagcugcuaccccgacgccggggagaucaucugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccgugucccccaacggcgcguacgggaucaagggcuucagcuucaaguacgggaacggcgucuggaucggccggacgaaguccaccaacagccgcuccggguucgagaugaucugggacccgaacggcuggaccgggaccgacagcaacuucuccgugaagcaggacaucguggccaucacggacuggagcggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacggggccgagcugcccuucaccaucgacaaguga

SEQ ID NO: 82052 - RNA, 1350 nt, Artificial Sequence
  derived and/or modified sequence opt1 from neuraminidase__InfluenzaA__AEO88965
augaaccccaaccagaagaucaucaccaucggcagcaucugcauggugaucgagaucgucucccugaugcuccagaucgggaacaugaucagcaucugggugucccacagcauccagaccaagaaccagcgccaggccgagccgaucuccaacacgaaguuccugaccgagaaggccguggcgagcgucacccuggccggcaacuccagccucugccccaucuccgggugggccgugcacagcaaggacaacuccauccggaucggcagcaagggggacguguucgucauccgcgagcccuucaucuccugcagccaccuggagugccggaccuucuuccugacgcagggcgcccuccugaacgacaagcacuccaacggcaccgugaaggaccgcagcccccaccggacccugauguccugcccggugggggaggcccccagccccuacaacucccgcuucgagagcgucgcguggagcgccuccgccugccacgacggcaccagcuggcucacgaucgggaucuccggccccgacaacggggccguggcggugcugaaguacaacggcaucaucaccgacaccaucaagagcuggcggaacaacauccugcgcacccaggaguccgagugcgccugcgucaacggcagcugcuucacggugaugaccgacgggccguccaacggccaggccagcuacaagaucuucaagauggagaaggggaagguggucaaguccguggagcucgacgcccccaacuaccacuacgaggagugcagcugcuaccccgacgccggcgagaucacgugcgugugccgggacaacuggcacggcuccaaccgccccugggucagcuucaaccagaaccuggaguaccagaucggguacaucugcuccggcguguucggggacaacccgcggcccaacgacggcaccgggagcugcggccccgugucccccaacggcgcguacggggucaagggcuucagcuucaaguacgggaacggcguguggaucgggcgcaccaaguccaccaacagccgguccggcuucgagaugaucugggacccgaacggcuggaccgggaccgacagcagcuucuccgugaagcaggacaucgucgccaucacggacuggagcggcuacuccgggagcuucgugcagcaccccgagcugaccggccucaacugcauccgccccugcuucugggucgagcuggugcgggggcgccccaaggaguccaccaucuggaccagcggcuccagcaucuccuucugcggcgugaacagcgacacggucgggugguccuggccggacggcgccgagcugcccuucaccaucgacaaguga

SEQ ID NO: 82053 - RNA, 1350 nt, Artificial Sequence
  derived and/or modified sequence opt1 from neuraminidase__InfluenzaA__AEO88973
augaaccccaaccagaagaucaucaccaucggcagcaucugcauggugaucgggaucgucucccugaugcuccagaucggcaacaugaucagccugugggugucccacagcauccagaccgggaaccagcaccagguggagccgaucuccaacacgaacuuccugaccgagaaggccgucgccagcgugacccucgcgggcaacuccagccugugccccauccgcgggugggccgugcacuccaaggacaacagcauccggaucggcuccaagggcgacgucuucgugauccgcgagcccuucaucagcugcucccaccuggagugccggaccuucuuccucacgcagggggcccugcugaacgacaagcacagcaacggcaccgugaaggaccgcagcccccaccggacccucaugagcugcccggucggggaggcccccucccccuacaacagccgcuucgaguccguggccuggagcgcgagcgccugccacgacggcaccuccuggcugacgaucgggaucagcggccccgacaacggcgccguggccguccugaaguacaacgggaugaucaccgacaccaucaaguccuggcggaacaacauccuccgcacccaggagagcgagugcgcgugcgugaacggcuccugcuucacggugaugaccgacgggccgagcaacggccaggccuccuacaagaucuucaagauggagaagggccgggucgugaaguccguggagcuggacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagccccaacggcgccuacggggugaagggcuucuccuucaaguacgggaacggcguguggaucggccggaccaagagcccgaacucccgcagcggguucgagaugaucugggaccccaacggcuggaucgagaccgacuccagcuucagcgucaagcaggacaucguggcgaucaccgacugguccggguacagcggcuccuucguccagcaccccgagcucaccgggcuggacugcauccggcccugcuucuggguggagcugauccgcggccggccgaaggagagcacgaucuggaccuccggcagcuccaucagcuucugcggggugaacuccgacaccgucagcugguccuggcccgacggcgccgagcuccccuucaccaucgacaaguga

SEQ ID NO: 82054 - RNA, 1350 nt, Artificial Sequence
  derived and/or modified sequence opt1 from neuraminidase__InfluenzaA__AEO88982
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcgugguccgccagcgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagcuacaagaucuucaagauggagaagggcaaggucgugaaguccguggagcucaacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcaucuucggggacaacccgcgcccccacgacggcaccggcagcugcgggcccgugucccccaacggcgcguacgggaucaagggcuucagcuucaaguacgggaacggcgucuggaucggccggaccaaguccaccaacagccgcuccggguucgagaugaucugggacccgaacggcuggaccgggaccgacagcaacuucuccgugaagcaggacaucguggccaucacggacuggagcggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacgacgccgagcugcccuucaccaucgacaaguga

SEQ ID NO: 82055 - RNA, 1350 nt, Artificial Sequence
  derived and/or modified sequence opt1 from neuraminidase__InfluenzaA__AEO88990
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcgugguccgccagcgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagcuacaagaucuucaagauggagaagggcaaggucgugaaguccguggagcucaacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgcguacgggaucaagggcuucagcuucaaguacgggaacggcguguggaucggccggaccaaguccaccaacagccgcuccggguucgagaugaucugggacccgaacggcuggaccgggaccgacagcaacuucuccgugaagcaggacaucgucgccaucacggacuggagcggcuacagcggguccuucgugcagcaccccgagcugaccggccucgacugcauccggcccugcuucugggucgagcugauccgcggccggcccaaggagagcaccaucuggaccuccgggagcuccaucagcuucugcggcgugaacuccgacacggugagcugguccuggccggacgacgccgagcugcccuucaccaucgacaaguga

SEQ ID NO: 82056 - RNA, 1350 nt, Artificial Sequence
  derived and/or modified sequence opt1 from neuraminidase__InfluenzaA__AEO88998
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccauccgggggugggccgugcacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcgugguccgccagcgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacgagcaggccagcuacaagaucuucaagauggagaagggcaagguggucaaguccguggagcucaacgcccccaacuaccacuacgaggagugcagcugcuaccccgacgccggcgagaucaucugcgugugccgcgacaacuggcacggguccaaccggcccugggucagcuucaaccagaaccuggaguaccagaucggcuacaucugcuccgggguguucggcgacaacccgcgccccaacgacgggaccggcagcugcggccccgugucccccaacggggcguacggcaucaagggguucagcuucaaguacggcaacggggucuggaucggccggaccaaguccacgaacagccgcuccggcuucgagaugaucugggacccgaacggguggaccggcaccgacagcaacuucuccgugaagcaggacaucguggccaucaccgacuggagcggguacagcggcuccuucguccagcaccccgagcugacggggcucgacugcauccggcccugcuucuggguggagcugauccgcggccggcccaaggagagcaccaucuggaccuccggcagcuccaucagcuucugcggggucaacuccgacaccgugagcugguccuggccggacggcgccgagcugcccuucacgaucgacaaguga

SEQ ID NO: 82057 - RNA, 1350 nt, Artificial Sequence
  derived and/or modified sequence opt1 from neuraminidase__InfluenzaA__AEO89006
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcgugguccgccagcgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagcuacaagaucuucaagauggagaagggcaaggucgugaaguccguggagcucaacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgcguacgggaucaagggcuucagcuucaaguacgggaacggcguguggaucggccggaccaaguccaccaacagccgcuccggguucgagaugaucugggacccgaacggcuggaccgggaccgacagcgacuucuccgugaagcaggacaucaucgccaucacggacuggagcggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacggggccgagcugcccuucaccaucgacaaguga

SEQ ID NO: 82058 - RNA, 1350 nt, Artificial Sequence
  derived and/or modified sequence opt1 from neuraminidase__InfluenzaA__AEO89023
augaaccccaaccagaagaucaucaccaucggcagcaucugcauggugaucgggaucgucucccugaugcuccagaucggcaacauggugagccugugggugucccacagcauccagaccgggaaccagcaccaggucgagccgaucuccaacacgaacuuccugaccgagaaggccguggccagcgugacccucgcgggcaacuccagccugugccccauccgcgggugggccguccacuccaaggacaacagcauccggaucggcuccaagggcgacguguucgugauccgcgagcccuucaucagcugcucccaccuggagugccggaccuucuuccucacgcagggggcccugcugaacgacaagcacagcaacggcaccgucaaggaccgcagcccccaccggacccucaugagcugcccggugggggaggcccccucccccuacaacagccgcuucgaguccguggccuggagcgcgagcgccugccacgacggcaccuccuggcugacgaucgggaucagcggccccgacaacggcgccgucgccgugcugaaguacaacgggaugaucaccgacaccaucaaguccuggcggaacaacauccuccgcacccaggagagcgagugcgcgugcgugaacggcuccugcuucacggucaugaccgacgggccgagcaacggccaggccuccuacaagaucuucaagauggagaagggcaagguggugaaguccgucgagcuggacgcccccaacuaccacuacgaggagugcuccugcuaccccgacgccggggagaucacgugcgugugccgggacaacuggcacggcagcaaccgccccuggguguccuucaaccagaaccuggaguaccagaucggguacaucugcagcggcgucuucggggacaacccgcggcccaacgacggcaccggcuccugcgggcccgugagccccaacggcgccuacggggugaagggcuucuccuucaaguacgggaacggcgucuggaucggccgcaccaagagcccguccagccgguccggguucgagaugaucugggaccccaacggcuggaccgagaccgacagcagcuucuccgugaagcaggacaucgucgcgaucaccgacuggagcggguacuccggcagcuucgugcagcaccccgagcucacggggcuggacugcauccgccccugcuucuggguggagcugauccggggccgcccgaaggaguccaccaucuggaccagcggcuccagcaucuccuucugcggggucaacagcgacaccguguccuggagcuggcccgacggcgccgagcuccccuucacgaucgacaaguga

SEQ ID NO: 82059 - RNA, 1350 nt, Artificial Sequence
  derived and/or modified sequence opt1 from neuraminidase__InfluenzaA__AEO89032
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacgcagggggcccuccugaacgacaagcacuccaacggcaccgugaaggaccggagcccccaccgcacccugauguccugcccggucggggaggcccccagccccuacaacucccgguucgagagcguggcgugguccgccagcgccugccacgacggcaccagcuggcucacgaucgggaucuccggccccgacaacggcgccguggcgguccugaaguacaacgggaucaucaccgacaccaucaagagcuggcgcaacaacauccugcggacccaggaguccgagugcgccugcgugaacggcagcugcuucacggugaugaccgacgggccguccaacggccaggccagcuacaagaucuucaagauggagaagggcaaggucgugaaguccguggagcucaacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgcguacgggaucaagggcuucagcuucaaguacgggaacggcguguggaucggccggaccaaguccaccaacagccgcuccggguucgagaugaucugggacccgaacggcuggaccgggaccgacagcaacuucuccgugaagcaggacaucgucgccaucacggacuggagcggcuacagcggguccuucgugcagcaccccgagcugaccggccucgacugcauccggcccugcuucugggucgagcugauccgcggccggcccaaggagagcaccaucuggaccuccgggagcuccaucagcuucugcggcgugaacuccgacacggugagcugguccuggccggacggggccgagcugcccuucaccaucgacaaguga

SEQ ID NO: 82060 - RNA, 1350 nt, Artificial Sequence
  derived and/or modified sequence opt1 from neuraminidase__InfluenzaA__AEO89041
augaaccccaaccagaagaucaucaccaucggcagcaucugcauggugaucgggcuggucucccucaugcugcagaucggcaacaugaucagcaucugggugucccacagcauccagaccgggaaccagcaccaggccgagccgauccgcaacacgaacuuccugaccgagaacgccguggcguccgucacccucgccggcaacagcucccugugccccgugcgggggugggccgugcacagcaaggacaacuccauccgcaucggcagcaagggcgacgucuucgugauccgggagcccuucaucuccugcagccaccuggagugccgcaccuucuuccucacgcagggggcccugcugaacgacaagcacuccaacggcaccgugaaggaccggagcccccaccgcacccucauguccugcccggucggggaggcccccagccccuacaacucccgguucgagagcguggcgugguccgccagcgccugccacgacggcaccagcuggcugacgaucgggaucuccggccccgacaacggcgccguggcgguccugaaguacaacgggaucaucaccgacaccaucaagagcuggcgcaacaacauccuccggacccaggaguccgagugcgccugcgugaacggcagcugcuucacggugaugaccgacgggccguccaacggccaggccagcuacaagaucuucaagauggagaagggcaaggucgugaaguccguggagcugaacgcccccaacuaccacuacgaggagugcagcugcuaccccgacgccggggagaucacgugcgucugccgcgacaacuggcacggcuccaaccggcccugggugagcuucaaccagaaccuggaguaccagaucggguacaucugcuccggcguguucggggacaacccgcgccccaacgacggcaccggcagcugcgggcccgucucccccaacggcgcguacgggaucaagggcuucagcuucaaguacgggaacggcguguggaucggccggaccaaguccaccaacagccgcuccggguucgagaugaucugggacccgaacggcuggaccgggaccgacagcaacuucuccgugaagcaggacaucgucgccaucacggacuggagcggcuacagcggguccuucgugcagcaccccgagcucaccggccuggacugcauccggcccugcuucuggaucgagcugauccgcggccggcccaaggagagcaccaucuggaccuccgggagcuccaucagcuucugcggcgucaacuccgacacggugagcugguccuggccggacggggccgagcuccccuucaccaucgacaaguga

SEQ ID NO: 82061 - RNA, 1350 nt, Artificial Sequence
  derived and/or modified sequence opt1 from neuraminidase__InfluenzaA__AEO89050
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacacgaacuuccugaccgagaacgccguggcguccgucacccuggccggcaacagcucccucugccccauccgggggugggccgugcacagcaaggacaacuccauccgcaucggcagcaagggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccgaugggggaggcccccagccccuacaacucccgguucgagagcguggcgugguccgccagcgccugccacgacggcaccagcuggcucacgaucgggaucuccggccccgacaacggcgccgucgcggugcugaaguacaacgggaucaucaccgacaccaucaagagcuggcgcaacaacauccugcggacccaggaguccgagugcgccugcgugaacggcagcugcuucacggucaugaccgacgggccguccaacggccaggccagcuacaagaucuucaagauggagaagggcaagguggugaaguccgucgagcucaacgcccccaacuaccacuacgaggagugcagcugcuaccccgacgccggggagaucaucugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgggcccgugucccccaacggcgcguacgggaucaagggcuucagcuucaaguacgggaacggcguguggaucggccggaccaaguccacgaacagccgcuccggguucgagaugaucugggacccgaacggcuggaccgggaccgacagcgacuucuccgucaagcaggacaucguggccaucaccgacuggagcggcuacagcggguccuucgugcagcaccccgagcugacgggccucgacugcauccggcccugcuucugggucgagcugauccgcggccggcccaaggagagcaccaucuggaccuccgggagcuccaucagcuucugcggcgugaacuccgacaccgucagcugguccuggccggacggggccgagcugcccuucacgaucgacaaguga

SEQ ID NO: 82062 - RNA, 1350 nt, Artificial Sequence
  derived and/or modified sequence opt1 from neuraminidase__InfluenzaA__AEO89058
augaaccccaaccagaagaucaucaccaucggcagcaucugcauggugaucgggaucgucucccugaugcuccagaucggcaacaugaucagcaucugggugucccacagcauccagaccgggaaccagcgccaggccgagccgaucuccaacacgaaguuccugaccgagaaggccguggcgagcgucacccuggccggcaacuccagccucugccccaucuccgggugggccguguacagcaaggacaacuccauccggaucggcagccgcggcgacguguucgucauccgggagcccuucaucuccugcagccaccuggagugccgcaccuucuuccugacgcagggggcccuccugaacgacaagcacuccaacggcaccgugaaggaccggagcccccaccgcacccugauguccugcccggugggggaggcccccagccccuacaacucccgguucgagagcgucgcguggagcgccuccgccugccacgacggcaccagcuggcucacgaucgggaucuccggccccgacaacggcgccguggcggugcugaaguacaacgggaucaucaccgacaccaucaagagcuggcgcaacaacauccugcggacccaggaguccgagugcgccugcgucaacggcagcugcuucacggugaugaccgacgggccguccaacggccaggccagcuacaagaucuucaagauggagaagggcaagguggucaaguccguggagcucgacgcccccaacuaccacuacgaggagugcagcugcuaccccgacgccggggagaucacgugcgugugccgcgacaacuggcacggcuccaaccggcccugggucagcuucaaccagaaccuggacuaccagaucggguacaucugcuccggcguguucggggacaacccgcgccccaacgacggcaccggcagcugcgggcccgugucccccaacggcgcguacggggucaagggcuucagcuucaaguacgggaacggcguguggaucggccggaccaaguccaccaacagccgcuccggguucgagaugaucugggacccgaacggcuggaccgggaccgacagcagcuucuccgugaagcaggacaucgucgccaucacggacuggagcggcuacuccgggagcuucgugcagcaccccgagcugaccggccucgacugcauccggcccugcuucugggucgagcugauccgcggccggcccaaggaguccaccaucuggaccagcggguccagcaucuccuucugcggcgugaacagcgacacgguguccuggagcuggccggacggggccgagcugcccuucaccaucgacaaguga

SEQ ID NO: 82063 - RNA, 1350 nt, Artificial Sequence
  derived and/or modified sequence opt1 from neuraminidase__InfluenzaA__AEO89075
augaaccccaaccagaagaucaucaccaucggcagcaucugcauggugaucgggaucgucucccugaugcuccagaucggcaacaugaucagcaucugggugucccacagcauccagcgcgggaaccugaaccagguggagccgaucuccaacaccaacuuccugacggagaaggccgucgccagcgugacccucgcgggcaacuccagccugugccccauccgggggugggccauccacuccaaggacaacagcauccgcaucggcuccaagggcgacguguucgucauccgggagcccuucaucagcugcucccaccuggagugccgcaccuucuuccucacccagggggcccugcugaacgacaagcacagcaacggcacggugaaggaccggagcccccaccgcacccucauguccugcccggugggggagguccccucccccuacaacagccgguucgaguccguggccuggagcgccagcgcgugccacgacggcaccuccuggcugaccaucgggaucagcggccccgacaacggcgccguggccgucgugaaguacaacgggaucaucacggacaccaucaaguccuggcgcaacaacauccugcggacccaggagagcgagugcgccugcgugaacggcuccugcuucaccgucaugacggacgggccgagcaacggccaggcguccuacaagaucuucaagauggagaagggcaaggugaucaagagcguggagcucgacgcccccaacuaccacuacgaggagugcuccugcuaccccgacgccggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagccccaacggcgccuacggggugaagggcuucuccuucaaguacgggaacggcguguggaucggccggaccaagagcccgaacucccgcagcggguucgagaugaucugggaccccaacggcugguccgagaccgacagcagcuucuccgucaagcaggacaucguggccaucaccgacuggagcggguacuccggcagcuucguccagcaccccgagcugaccgggcucgacugcauccggcccugcuucuggguggagcugauccgcggccggccgaaggaguccaccaucuggacgagcggcuccagcaucuccuucugcggggugaacagcgacaccgucuccuggagcuggcccgacggcgcggagcugcccuucaccaucgacaaguga

SEQ ID NO: 82064 - RNA, 1350 nt, Artificial Sequence
  derived and/or modified sequence opt1 from neuraminidase__InfluenzaA__AEO89084
augaaccccaaccagaagaucaucaccaucggcagcaucugcauggugaucgggaucgucucccugaugcuccagaucggcaacaugaucagcaucuggaucuccuacagcauccagaccgggaaccagcaccaggccgagccgacgcgcaacgccaccuuccugaccgagaacgcgguggccuccgugacccuggccggcaacagcucccucugccccguccgggggugggccgugcacagcaaggacaacuccauccgcaucggcagcaagggcgacguguucgucauccgggagcccuucaucuccugcagccaccuggagugccgcacguucuuccugacccagggggcccuccugaacgacaagcacuccaacggcaccgugaaggaccggagcccccaccgcacccugauguccugcccggugggggaggcgcccagccccuacaacucccgguucgagagcgucgccugguccgccagcgccugccacgacggcacgagcuggcucaccaucgggaucuccggccccgacaacggcgcgguggccgugcugaaguacaacgggaucaucaccgacaccaucaagagcuggcgcaacaacauccugcggacgcaggaguccgagugcgccugcgucaacggcagcugcuucaccgugaugaccgacgggccguccgacggccaggccagcuacaagaucuucaagauggagaagggcaagguggucaaguccguggagcucaucgcccccaacuaccacuacgaggagugcagcugcuaccccgacgcgggggagaucacgugcgugugccgcgacaacuggcacggcuccaaccggcccugggucagcuucaaccagaaccuggaguaccagaucggguacaucugcuccggcguguucggggacaacccgcgccccaacgacggcaccggcagcugcgggcccgugucccccaacggcgccuacgggaucaagggcuucagcuucaaguacgggaacggcgucuggaucggccggaccaaguccaccaacagccgcuccggguucgagaugaucugggacccgaacggcuggaccgagacggacagcaacuucuccgugaagcaggacaucguggccaucaccgacuggagcggguacagcggcuccuucguccagcaccccgagcugaccgggcucgacugcauccggcccugcuucuggguggagcugauccgcggccggcccaaggagagcaccaucuggacguccggcagcuccaucagcuucugcggggucaacuccgacaccgugagcugguccuggccggacggcgccgagcugcccuucaccaucgacaaguga

SEQ ID NO: 82065 - RNA, 1350 nt, Artificial Sequence
  derived and/or modified sequence opt1 from neuraminidase__InfluenzaA__AEO89093
augaaccccaaccagaagaucaucaccaucggcagcaucugcauggugaucgggaucgucucccugaugcuccagaucggcaacaugaucagccugugggugucccacagcauccagaccgggaaccagcaccagguggagccgaucuccaacacgaacuuccuggucgagaaggccguggccagcgugacccucgcgggcaacuccagccugugccccauccgcgggugggccguccacuccaaggacaacagcauccggaucggcuccaagggcgacguguucgugauccgcgagcccuucaucagcugcucccaccuggagugccggaccuucuuccucacccagggggcccugcugaacgacaagcacagcaacggcacggucaaggaccgcagcccccaccggacccucaugagcugcccggugggggaggcccccucccccuacaacagccgcuucgaguccguggccuggagcgcgagcgccugccacgacggcaccuccuggcugaccaucgggaucagcggccccgacaacggcgccgucgccgugcugaaguacaacgggaugaucacggacaccaucaaguccuggcggaacaacauccuccgcacccaggagagcgagugcgcgugcgugaacggcuccugcuucaccgucaugacggacgggccgagcaacggccaggccuccuacaagaucuucaagauggagaagggccggguggugaaguccgucgagcuggacgcccccaacuaccacuacgaggagugcuccugcuaccccgacgccggggagaucacgugcgugugccgcgacaacuggcacggcagcaaccggcccuggguguccuucaaccagaaccuggaguaccagaucggguacaucugcagcggcgucuucggggacaacccgcgccccaacgacggcaccggcuccugcgggcccgugagcuccaacggcgccuacggggugaagggcuucagcuucaaguacgggaacggcgucuggaucggccggaccaagucccccaacagccgcuccggguucgagaugaucugggacccgaacggcuggaccgagaccgacagcagcuucuccgugaagcaggacaucgucgcgaucaccgacuggagcggguacuccggcagcuucgugcagcaccccgagcucaccgggcuggacugcauccggcccugcuucuggguggagcugauccgcggccggcccaaggaguccacgaucuggaccagcggcuccagcaucuccuucugcggggucaacagcgacaccguguccuggagcuggccggacggcgccgagcuccccuucaccaucgacaaguga

SEQ ID NO: 82066 - RNA, 1350 nt, Artificial Sequence
  derived and/or modified sequence opt1 from neuraminidase__InfluenzaA__AEO89102
augaaccccaaccagaagaucaucaccaucggcagcaucugcauggugaucgggaucgucucccugaugcuccagaucggcaacaugaucagcaucuggaucucccacagcauccagaccgggaaccagaaccagguggagccgaucuccaacacgaacuuccugaccgagaaggccguggccagcgucauccuggcgggcaacuccagccucugccccauccgcgggugggccauccacuccaaggacaacagcauccggaucggcuccaagggcgacguguucgugauccgcgagcccuucaucagcugcucccaccuggagugccggaccuucuuccugacccagggggcccuccugaacgacaagcacagcaacggcacggucaaggaccgcagcccccaccggacccugauguccugcccggugggggaggcccccucccccuacaacagccgcuucgaguccguggccuggagcgcgagcgccugccacgacggcaccuccuggcucaccaucgggaucagcggccccgacuccggcgccgucgccgugcugaaguacaacgggaucaucacggacaccaucaagagcuggcggaacaacauccugcgcacccaggaguccgagugcgcgugcgugaacggcagcugcuucaccgucaugacggacgggccguccaacggccaggccagcuacaagaucuucaagauggagaagggcaaggugaucaaguccguggagcucgacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucucccacaacggcgccuacggggugaagggcuucagcuucaaguacgggaacggcguguggaucggccgcaccaagucccccaacagccgguccggguucgagaugaucugggacccgaacggcuggagcgagaccgacagcuccuucagcgucaagcaggacaucguggcgaucaccgacugguccggguacagcggcuccuucgugcagcaccccgagcugaccgggcucgacugcauccgccccugcuucugggucgagcugauccggggccgccccaaggagagcaccguguggacguccggcagcuccaucagcuucugcggggucaacuccgacaccgugagcugguccuggccggacggcgccgagcugcccuucaccaucgacaaguga

SEQ ID NO: 82067 - RNA, 1350 nt, Artificial Sequence
  derived and/or modified sequence opt1 from neuraminidase__InfluenzaA__AEO89111
augaaccccaaccagaagaucaucaccaucggcagcaucugcauggugaucgggaucgucucccugaugcuccagaucggcaacaucaucagcaucugggugucccacagcauccagaccgggaaccagcaccaggacgagccgauccgcaacgccaacgugcugacggagaacgccgucgcguccgugacccuggccggcaacagcucccucugccccgugcgggggugggccguccacagcaaggacaacuccauccgcaucggcagcaagggcgacguguucgugauccgggagcccuucaucuccugcagccaccuggagugccgcaccuucuuccugacccagggggcccuccugaacgacaagcacuccaacggcacggucaaggaccggagcccccaccgcacccugauguccugcccggugggggaggcccccagccccuacaacucccgguucgagagcguggcgugguccgccagcgccugccacgacggcaccagcuggcucaccaucgggaucuccggccccgacaacggcgccgucgcggugcugaaguacaacgggaucaucacggacaccaucaagagcuggcgcaacaacauccugcggacccaggaguccgagugcgccugcgugaacggcagcugcuucaccgucaugacggacgggccguccaacggccaggccagcuacaagaucuucaagauggagaagggcaagguggugaaguccgucgagcucaacgcccccaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgaccccgugucccccaacggggcguacggcaucaagggguucagcuucaaguacggcaacgggguguggaucggccggaccaaguccaccaacagccgcuccggcuucgagaugaucugggacccgaacggguggaccgagaccgacagcaacuucuccgucaagcaggacaucguggccaucaccgacuggagcggcuacagcggguccuucguccagcaccccgagcugacgggccucgacugcauccggcccugcuucuggguggagcugauccgcgggcggcccaaggagagcaccaucuggaccuccggcagcuccaucagcuucugcggcgugaacuccgacaccgucagcugguccuggccggacggggccgagcugcccuucacgaucgacaaguga

SEQ ID NO: 82068 - RNA, 1350 nt, Artificial Sequence
  derived and/or modified sequence opt1 from neuraminidase__InfluenzaA__AEO89120
augaaccccaaccagaagaucaucaccaucggcagcaucugcauggugaucgggaucgucucccugaugcuccagaucggcaacaugaucagcaucugggugucccacagcauccagaccgggaaccagcaccaggccgagccgauccgcaacgccuccuuccugacggagaacgcgguggccagcgucacccuggccggcaacuccagccucugccccgugcgggggugggccgugcacuccaaggacaacagcauccgcaucggcuccaagggcgacgucuucgugauccgggagcccuucaucagcugcucccaccuggagugccgcaccuucuuccugacccagggggcccuccugaacgacaagcacagcaacggcacggugaaggaccggagcccccaccgcacccugaugagcugcccggucggggaggcgcccucccccuacaacagccgguucgaguccguggccuggagcgccagcgccugccacgacggcaucuccuggcucaccaucgggaucagcggccccgacaacggcgcgguggccguccugaaguacaacgggaucaucaccgacacgaucaaguccuggcgcaacaacauccugcggacccaggagagcgagugcgccugcgugaacggcuccugcuucaccgugaugaccgacgggccgagcaacggccaggccuccuacaagaucuucaagauggagaagggcaaggucgugaaguccguggagcucaacgcccccaacuaccacuacgaggagugcuccugcuaccccgacgcgggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagccccaacggcgccuacgggaucaagggcuucuccuucaaguacgggaacggcguguggaucggccggaccaagagcaccaacucccgcagcggguucgagaugaucugggacccgaacggcugggccgagacggacuccaacuucagcgugaagcaggacaucgucgccaucaccgacuggagcggguacuccggcagcuucgugcagcaccccgagcugaccgggcucgacugcauccggcccugcuucugggucgagcugauccgcggccggcccaaggagggcaccaucuggacguccgggagcuccaucagcuucugcggcgugaacuccgacaccgugagcugguccuggccggacggggccgagcugcccuucaccaucgacaaguga

SEQ ID NO: 82069 - RNA, 1350 nt, Artificial Sequence
  derived and/or modified sequence opt1 from neuraminidase__InfluenzaA__AEO89129
augaaccccaaccagaagaucaucaccaucggcagcaucugcauggugaucgggaucgucucccugaugcuccagaucggcaacaucaucagcaucugggugucccacagcacccagacggggaaccagcaccaggacgagccgauccgcaacgccaacuuccugaccgagaacgccguggcguccgucacccuggccggcaacagcucccucugccccgugcgggggugggccgugcacagcaaggacaacuccauccgcgucggcagcaagggcgacguguucgugauccgggagcccuucaucuccugcagccaccuggagugccgcaccuucuuccugacgcagggggcccuccugaacgacaagcacuccaacggcaccgucaaggaccggagcccccaccgcacccugauguccugcccggugggggaggcccccagccccuacaacucccgguucgagagcguggcgugguccgccagcgccugccacgacggcaccagcuggcucacgaucgggaucuccggccccgacaacggcgccgucgcggugcugaaguacaacgggaucaucaccgacaccaucaagagcuggcgcaacaacauccugcggacccaggaguccgagugcgccugcgugaacggcagcugcuucacggucaugaccgacgggccguccaacggccaggccagcuacaagaucuucaagauggagaagggcaagguggugaaguccgucgagcucaacgcccccaacuaccacuacgaggagugcagcugcuaccccgacgccggggagaucacgugcgugugccgcgacaacuggcacggcuccaaccggcccugggugagcuucaaccagaaccuggaguaccagaucggguacaucugcuccggcgucuucggggacaacccgcgccccaacgacggcaccggcagcugcgaccccgugucccccaacggggcguacggcaucaagggguucagcuucaaguacggcaacgggguguggaucggccggaccaaguccaccaacagccgcuccggcuucgagaugaucugggacccgaacggguggaccgagaccgacagcaacuucuccgucaagcaggacaucguggccaucacggacuggagcggcuacagcggguccuucguccagcaccccgagcugaccggccucgacugcauccggcccugcuucuggguggagcugauccgcgggcggcccaaggagagcaccaucuggaccuccggcagcuccaucagcuucugcggcgugaacuccgacacggucagcugguccuggccggacggggccgagcugcccuucaccaucgacaaguga

SEQ ID NO: 82070 - RNA, 1350 nt, Artificial Sequence
  derived and/or modified sequence opt1 from neuraminidase__InfluenzaA__AEO89138
augaaccccaaccagaagaucaucaccaucggcagcaucugcauggugaccgggaucgucucccugaugcuccagaucggcaacaucaucagcaugugggugucccacagcauccagacgcgcaaccagcaccaggccgagccgauccggaacaccaacuuccugaccgagaacgccguggcguccgucacccugacggggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccuccugaacgacaagcacuccaacgggaccgugaaggaccgcagcccccaccggacgcugauguccugcccggugggcgaggcccccagccccuacaacucccgcuucgagagcgucgccugguccgcgagcgccugccacgacgggaccagcuggcucaccaucggcaucuccgggcccgacaacggcgccguggccgugcugaaguacaacggcaucaucaccgacacgaucaagagcuggcggaacaacauccugcgcacccaggaguccgagugcgcgugcgucaacgggagcugcuucaccgugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggacgggcagcugcggccccgugucccccaacggggccuacggcaucaagggguucagcuucaaguacggcaacggggucuggaucggccgcaccaaguccaccaacagccgguccggcuucgagaugaucugggacccgaacggguggaccggcacggacaacgacuucagcgugaagcaggacaucguggcgaucaccgacugguccggguacagcggcagcuucguccagcaccccgagcugaccgggcucgacugcauccgccccugcuucuggguggagcugauccggggccgccccaaggaguccaccgucuggacgagcggcuccagcaucuccuucugcggggugaacagcgacaccguguccuggagcuggccggacggcgccgagcugcccuucaccaucgacaaguga

SEQ ID NO: 82071 - RNA, 1350 nt, Artificial Sequence
  derived and/or modified sequence opt1 from neuraminidase__InfluenzaA__AEO89156
augaaccccaaccagaagaucaucaccaucggcagcaucugcauggugaccgggaucgucucccugaugcuccagaucggcaacaucacgagcaugugggugucccacagcauccagacccgcaaccagcaccaggccgagccgauccggaacaccaacuuccugaccgagaacgccguggcguccgucacgcuggccgggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccuccugaacgacaagcacuccaacgggaccgugaaggaccgcagcccccaccggacgcugauguccugcccggugggcgaggcccccagccccuacaacucccgcuucgagagcgucgcgugguccgccagcgccugccacgacgggaccagcuggcucaccaucggcaucuccgggcccgacaacggcgccguggcggugcugaaguacaacggcaucaucaccgacacgaucaagagcuggcggaacaacauccugcgcacccaggaguccgagugcgccugcgucaacgggagcugcuucaccgugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggacgggcagcugcggccccgugucccccaacggggcguacggcaucaagggguucagcuucaaguacggcaacggggucuggaucggccgcaccaaguccaccaacagccgguccggcuucgagaugaucugggacccgaacggguggaccggcacggacagcgacuucuccgugaagcaggacaucguggccaucaccgacuggagcggguacagcggcuccuucguccagcaccccgagcugaccgggcucgacugcauccgccccugcuucuggguggagcugauccggggccgccccaaggagagcaccaucuggacguccggcagcuccaucagcuucugcggggucaacuccgacaccgugagcugguccuggccggacggcgccgagcugcccuucaccaucgacaaguga

SEQ ID NO: 82072 - RNA, 1350 nt, Artificial Sequence
  derived and/or modified sequence opt1 from neuraminidase__InfluenzaA__AEO89174
augaaccccaaccagaagaucaucaccaucggcagcaucugcauggugaccgggaucgucucccugaugcuccagaucggcaacaucaucagcaugugggugucccacagcauccagacgcgcaaccagcaccaggccgagccgauccggaacaccaacuuccugaccgagaacgccguggcguccgucacccuggccgggaacagcucccucugccccauccgcggcugggccgugcacagcaaggacaacuccauccggaucgggagcaagggcgacguguucgucauccgcgagcccuucaucuccugcagccaccuggagugccggacguucuuccugacccagggcgcccuccugaacgacaagcacuccaacgggaccgugaaggaccgcagcccccaccggacccugauguccugcccggugggcgaggcccccagccccuacaacucccgcuucgagagcgucgcgugguccgccagcgccugccacgacgggacgagcuggcucaccaucggcaucuccgggcccgacaacggcgccguggcggugcugaaguacaacggcaucaucaccgacaccaucaagagcuggcggaacaacauccugcgcacgcaggaguccgagugcgccugcgucaacgggagcugcuucaccgugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccgugucccccaacggggcguacggcaucaagggguucagcuucaaguacggcaacggggucuggaucggccgcacgaaguccaccaacagccgguccggcuucgagaugaucugggacccgaacggguggaccggcaccgacagcgacuucuccgugaagcaggacaucguggccaucacggacuggagcggguacagcggcuccuucguccagcaccccgagcugaccgggcucgacugcauccgccccugcuucuggguggagcugauccggggccgccccaaggagagcaccaucuggaccuccggcagcuccaucagcuucugcggggucaacuccgacacggugagcugguccuggccggacggcgccgagcugcccuucaccaucgacaaguga

SEQ ID NO: 82073 - RNA, 1350 nt, Artificial Sequence
  derived and/or modified sequence opt1 from neuraminidase__InfluenzaA__AEO89183
augaaccccaaccagaagaucgugaccaucggcagcaucugcauggucaucgggaucgugucccugaugcuccagaucggcaacaugaucagcaucugggugucccacagcauccagaccgggaaccagcaccagacggagccgauccgcaacaccaacuuccugaccgagaacaccgucgccuccgugacgcuggccggcaacagcucccucugccccauccgggggugggcggugcacagcaaggacaacuccauccgcaucggcagcaagggcgacgucuucgugauccgggagcccuucaucuccugcagccaccuggagugccgcaccuucuuccugacccagggggcccuccugaacgacaagcacuccaacggcaccgugaaggaccggagcccccaccgcacgcugauguccugcccgaucggggaggcccccagccccuacaacucccgguucgagagcgucgccugguccgccagcgcgugccacgacggcaccagcuggcucaccaucgggaucuccggccccgacaacggcgccguggccgugcugaaguacaacgggaucaucaccgacacgaucaagagcuggcgcaacaacauccugcggacccaggaguccgagugcgccugcgucaacggcagcugcuucaccgugaugaccgacgggccguccaacggccaggcgagcuacaagaucuucaagauggagaagggcaagguggucaaguccguggagcucaacgcccccaacuaccacuacgaggagugcagcugcuaccccgacgccggggagaucaucugcgugugccgcgacaacuggcacggcuccaaccggcccugggucagcuucaaccagaaccuggaguaccagaucggguacaucugcuccggcguguucggggacaacccgcgccccaacgacggcaagggcagcugcgggcccgugucccccaacggcgccuacggggucaagggcuucagcuucaaguacgggaacggcguguggaucggccggacgaaguccacccacagccgcuccggguucgagaugaucugggacccgaacggcuggaccgggaccgacagcgaguucuccaugaagcaggacaucguggccaucacggacuggagcggcuacagcggguccuucguccagcaccccgagcugaccggccucgacugcauccggcccugcuucuggguggagcugauccgcggccggcccaaggagagcaccaucuggaccuccgggagcuccaucagcuucugcggcgucaacuccgacacggugagcugguccuggccggacggggcggagcugcccuucaccaucgacaaguga

SEQ ID NO: 82074 - RNA, 1350 nt, Artificial Sequence
  derived and/or modified sequence opt1 from neuraminidase__InfluenzaA__AEO89205
augaaccccacccagaagaucaucaccaucggcagcaucugcauggugaucgggaucgucucccugaugcuccagaucggcaacaugaucagcaucugggugucccacagcauccagacggggaaccagcaccaggccgagccgauccgcaacgccuccuuccugaccgagaacgcgguggccagcgucacccuggccggcaacuccagccucugccccgugcgggggugggccgugcacuccaaggacaacagcauccgcaucggcuccaagggcgacgucuucgugauccgggagcccuucaucagcugcucccaccuggagugccgcaccuucuuccugacgcagggggcccuccugaacgacaagcacagcaacggcaccgugaaggaccggagcccccaccgcacccugaugagcugcccggucggggaggcgcccucccccuacaacagccgguucgaguccguggccuggagcgccagcgccugccacgacggcaucuccuggcucaccaucgggaucagcggccccgacaacggcgcgguggccguccugaaguacaacgggaucaucacggacaccaucaaguccuggcgcaacaacauccugcggacccaggagagcgagugcgccugcgugaacggcuccugcuucaccgugaugacggacgggccgagcaacggccaggccuccuacaagaucuucaagauggagaagggcaaggucgugaaguccguggagcucaacgcccccaacuaccacuacgaggagugcuccugcuaccccgacgcgggggagaucacgugcgucugccgcgacaacuggcacggcagcaaccggcccuggguguccuucaaccagaaccuggaguaccagaucggguacaucugcagcggcguguucggggacaacccgcgccccaacgacggcaccggcuccugcgggcccgucagccccaacggcgccuacgggaucaagggcuucuccuucaaguacgggaacggcguguggaucggccggaccaagagcaccaacucccgcagcggguucgagaugaucugggacccgaacggcugggccgagaccgacuccaacuucagcgugaagcaggacaucgucgccaucaccgacuggagcggguacuccggcagcuucgugcagcaccccgagcugaccgggcucgacugcauccggcccugcuucugggucgagcugauccgcggccggcccaaggagggcacgaucuggaccuccgggagcuccaucagcuucugcggcgugaacuccgacaccgugagcugguccuggccggacggggccgagcugcccuucaccaucgacaaguga

SEQ ID NO: 82075 - RNA, 1350 nt, Artificial Sequence
  derived and/or modified sequence opt1 from neuraminidase__InfluenzaA__AEO89215
augaaccccaaccagaagaucaucaccaucggcagcaucugcauggccaucgggaucgugucccugaugcuccagaucggcaacaugaucagcaucugggucucccacagcauccagaccgggaaccagcaccaggccgagccgauccgcaacgcguccuuccugacggagaacgccguggccagcgugacccuggccggcaacuccagccucugccccguccgggggugggccgugcacuccaaggacaacagcauccgcaucggcuccaagggcgacguguucgucauccgggagcccuucaucagcugcucccaccuggagugccgcaccuucuuccugacccagggggcgcuccugaacgacaagcacagcaacggcacggugaaggaccggagcccccaccgcacccugauguccugcccggugggggaggcccccucccccuacaacagccgguucgaguccgucgccuggagcgccagcgcgugccacgacggcaucuccuggcucaccaucgggaucagcggccccgacaacggcgccguggccgugcugaaguacaacgggaucaucaccgacacgaucaaguccuggcgcaacaacauccugcggacccaggagagcgagugcgccugcgucaacggcuccugcuucaccgugaugaccgacgggccgagcaacggccaggccuccuacaagaucuucaagauggagaagggcaagguggucaagagcguggagcucaacgcgcccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagccccaacggcgccuacgggaucaagggcuucuccuucaaguacgggaacggcgucuggaucggccggaccaagagcaccaacucccgcagcggguucgagaugaucugggacccgaacggcugggccgagacggacuccaacuucagcgugaagcaggacaucguggccaucaccgacuggagcggguacuccggcagcuucguccagcaccccgagcugaccgggcucgacugcauccggcccugcuucuggguggagcugauccgcggccggcccaaggagggcaccaucuggacguccgggagcuccaucagcuucugcggcgucaacuccgacaccgugagcugguccuggccggacggggcggagcugcccuucaccaucgacaaguga

SEQ ID NO: 82076 - RNA, 1350 nt, Artificial Sequence
  derived and/or modified sequence opt1 from neuraminidase__InfluenzaA__AEO89226
augaaccccacccagaagaucaucaccaucggcagcaucugcauggccaucgggaucgugucccugaugcuccagaucggcaacaugaucagcaucugggucucccacagcauccagacggggaaccagcaccaggccgagccgauccgcaacgcguccuuccugaccgagaacgccguggccagcgugacccuggccggcaacuccagccucugccccguccgggggugggccgugcacuccaaggacaacagcauccgcaucggcuccaagggcgacguguucgucauccgggagcccuucaucagcugcucccaccuggagugccgcaccuucuuccugacgcagggggcgcuccugaacgacaagcacagcaacggcaccgugaaggaccggagcccccaccgcacccugauguccugcccggugggggaggcccccucccccuacaacagccgguucgaguccgucgccuggagcgccagcgcgugccacgacggcaucuccuggcucaccaucgggaucagcggccccgacaacggcgccguggccgugcugaaguacaacgggaucaucacggacaccaucaaguccuggcgcaacaacauccugcggacccaggagagcgagugcgccugcgucaacggcuccugcuucaccgugaugacggacgggccgagcaacggccaggccuccuacaagaucuucaagauggagaagggcaagguggucaagagcguggagcucaacgcgcccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagccccaacggcgccuacgggaucaagggcuucuccuucaaguacgggaacggcgucuggaucggccggaccaagagcaccaacucccgcagcggguucgagaugaucugggacccgaacggcugggccgagaccgacuccaacuucagcgugaagcaggacaucguggccaucaccgacuggagcggguacuccggcagcuucguccagcaccccgagcugaccgggcucgacugcauccggcccugcuucuggguggagcugauccgcggccggcccaaggagggcacgaucuggaccuccgggagcuccaucagcuucugcggcgucaacuccgacaccgugagcugguccuggccggacggggcggagcugcccuucaccaucgacaaguga

SEQ ID NO: 82077 - RNA, 1350 nt, Artificial Sequence
  derived and/or modified sequence opt1 from neuraminidase__InfluenzaA__AEO89237
augaaccccaaccagaagaucaucaccaucggcagcaucugcauggugaucgggaucgucucccugaugcuccagaucggcaacaucaucagcaugugggugucccacagcauccagacccgcaaccagcaccaggccgagccgauccggaacacgaacuuccugaccgagaacgccguggcguccgucacccuggccgggaacagcucccucugccccauccgcggcugggccgugcacagcaaggacaacuccauccggaucgggagcaagggcgacguguucgucauccgcgagcccuucaucuccugcagccaccuggagugccggaccuucuuccugacgcagggcgcccuccugaacgacaagcacuccaacgggaccgugaaggaccgcagcccccaccggacccugauguccugcccggugggcgaggcccccagccccuacaacucccgcuucgagagcgucgcgugguccgccagcgccugccacgacgggaccagcuggcucacgaucggcaucuccgggcccgacaacggcgccguggcggugcugaaguacaacggcaucaucaccgacaccaucaagagcuggcggaacaacauccugcgcacccaggaguccgagugcgccugcgucaacgggagcugcuucacggugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccgugucccccaacggggcguacggcaucaagggguucagcuucaaguacggcaacggggucuggaucggccgcaccaaguccacgaacagccgguccggcuucgagaugaucugggacccgaacggguggaccggcaccgacagcgacuucuccgugaagcaggacaucguggccaucaccgacuggagcggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 82078 - RNA, 1350 nt, Artificial Sequence
  derived and/or modified sequence opt1 from neuraminidase__InfluenzaA__AEO89248
augaaccccaaccagaagaucaucaccaucggcagcaucugcauggugaucgggaucgucucccugaugcuccagaucggcaacaucaucagcaucugggugucccacagcuuccagacccgcgugcagcaccaggccgagccgauccggaacacgaacuuccugaccgagaacgccgucgcguccgugacccuggccgggaacagcucccucugccccauccgcggcugggccgugcacagcaaggacaacuccauccggaucgggagcaagggcgacgucuucgugauccgcgagcccuucaucuccugcagccaccuggagugccggaccuucuuccugacgcagggcgcccuccugaacgacaagcacuccaacgggaccgugaaggaccgcagcccccaccggacccugauguccugcccggucggcgaggcccccagccccuacaacucccgcuucgagagcguggcgugguccgccagcgccugccacgacgggaccagcuggcucacgaucggcaucuccgggcccgacaacggcgccguggcgguccugaaguacaacggcaucaucaccgacaccaucaagagcuggcggaacaacauccugcgcacccaggaguccgagugcgccugcgugaacgggagcugcuucacggugaugaccgacggcccguccaacgggcaggccagcuacaagaucuucaagaugaagaagggcaaggucgugaaguccguggagcucaacgcccccaacuaccacuacgaggagugcagcugcuaccccgacgccggcgagaucaucugcgucugccgggacaacuggcacggguccaaccgccccugggugagcuucaaccagaaccuggaguaccagaucggcuacaucugcuccgggguguucggcgacaacccgcggcccaacgacgggaccggcagcugcggccccgucucccccaacggggcguacggcaucaagggguucagcuucaaguacggcaacgggguguggaucggccgcaccaaguccacgaacagccgguccggcuucgagaugaucugggacccgaacggguggaccggcaccgacagcgacuucuccaugaagcaggacaucguggccaucaccgacuggagcggguacagcggcuccuucguccagcaccccgagcugacggggcucgacugcauccgccccugcuucuggguggagcugauccggggccgccccaaggagagcaccaucuggaccuccggcagcuccaucagcuucugcggggucaacuccgacaccgugagcugguccuggccggacggcgccgagcugcccuucacgaucgacaaguga

SEQ ID NO: 82079 - RNA, 1350 nt, Artificial Sequence
  derived and/or modified sequence opt1 from neuraminidase__InfluenzaA__AEO89270
augaaccccaaccagaagaucaucaccaucggcagcaucugcauggugaccgggaucgucucccugaugcuccagaucggcaacaucacgagcaugugggugucccacagcauccagacccgcaaccagcaccaggccgagccgauccggaacaccaacuuccugaccgagaacgccguggcguccgucacgcuggccgggaacagcucccucugccccauccgcggcugggccgugcacagcaaggacaacuccauccggaucgggagcaagggcgacguguucgucauccgcgagcccuucaucuccugcagccaccuggagugccggaccuucuuccugacccagggcgcccuccugaacgacaagcacuccaacgggaccgugaaggaccgcagcccccaccggacgcugauguccugcccggugggcgaggcccccagccccuacaacucccgcuucgagagcgucgcgugguccgccagcgccugccacgacgggaccagcuggcucaccaucggcaucuccgggcccgacaacggcgccguggcggugcugaaguacaacggcaucaucaccgacacgaucaagagcuggcggaacaacauccugcgcacccaggaguccgagugcgccugcgucaacgggagcugcuucaccgugaugaccgacggcccguccaacgggcaggccagcuacaagaucuucaagauggagaagggcaagguggucaaguccguggagcucaacgcccccaacuaccacuacgaggagugcagcugcuaccccgacgccggcgagaucaucugcgugugccgggacaacuggcacggguccaaccgccccugggucagcuucaaccagaaccuggaguaccagaucggcuacaucugcuccgggguguucggcgacaacccgcggcccaacgacgggacgggcagcugcggccccgugucccccaacggggcguacggcaucaagggguucagcuucaaguacggcaacggggucuggaucggccgcaccaaguccaccaacagccgguccggcuucgagaugaucugggacccgaacggguggaccggcacggacagcgacuucuccgugaagcaggacaucguggccaucaccgacuggagcggguacagcggcuccuucguccagcaccccgagcugaccgggcucgacugcauccgccccugcuucuggguggagcugauccggggccgccccaaggagagcaccaucuggacguccggcagcuccaucagcuucugcggggucaacuccgacaccgugggcuggagcuggccggacggggccgagcugcccuucaccaucgacaaguga

SEQ ID NO: 82080 - RNA, 1350 nt, Artificial Sequence
  derived and/or modified sequence opt1 from neuraminidase__InfluenzaA__AEO89281
augaaccccaaccagaagaucaucaccaucggcagcaucugcaugguggucgggaucgugucccugaugcuccagaucggcaacaucgugagcaucugggucucccacagcauccagaccgggcaccagcagcaggccgagccgaucaagaacacgaacuuccugaccaagaacgccguggcguccgugacccuggccggcaacagcucccucugccccauccgcgggugggccguccacagcaaggacaacuccauccggaucggcagcaagggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggcgugguccgccagcgccugccacgacggcaccagcuggcucacgaucgggaucuccggccccgacaacggcgccgucgcggugcugaaguacaacgggaucaucaccgacaccaucaagagcuggcggaacaacacccugcgcacgcaggaguccgagugcgccugcgugaacggcagcugcuucaccgucaugaccgacgggccguccaacggccaggccagcuacaagaucuucaagauggagaagggcaagguggugaaguccgccgagcucaacgcccccaacuaccacuacgaggagugcagcugcuaccccgacgcgggggagaucaucugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucucccccaacggcgccuacgggaucaagggcuucagcuucaaguacgggaacggcguguggaucggccgcacgaaguccaccaacagccgguccggguucgagaugaucugggacccgaacggcuggaccgggaccgacagcaacuucuccaugaagcaggacaucguggccaucacggaguggagcggcuacagcggguccuucguccagcaccccgagcugaccggccucgacugcauccgccccugcuucuggguggagcugauccggggccgccccaaggagagcaccaucuggaccuccgggagcuccaucagcuucugcggcgucaacuccgacacggugagcugguccuggccggacggggccgagcugcccuucaccaucgacaaguga

SEQ ID NO: 82081 - RNA, 1350 nt, Artificial Sequence
  derived and/or modified sequence opt1 from neuraminidase__InfluenzaA__AEO89291
augaaccccaaccagaagaucaucaccaucggcagcaucugcaugguggucgggaucgugucccugaugcuccagaucggcaacaucgugagcaucugggucucccacagcauccagaccgggcaccagcagcaggccgagccgaucaagaacacgaacuuccugaccgagaacgccguggcguccgugacccuggccggcaacagcucccucugccccauccgcgggugggccguccacagcaaggacaacuccauccggaucggcagcaagggcgacguguucgugauccgcgagcccuucaucuccugcagccaccuggagugccggaccuucuuccugacgcagggggcccuccugaacgacaagcacuccaacggcaccgucaaggaccgcagcccccaccggacccugauguccugcccggugggggaggcccccagccccuacaacucccgcuucgagagcguggcgugguccgccagcgccugccacgacggcaccagcuggcucacgaucgggaucuccggccccgacaacggcgccgucgcggugcugaaguacaacgggaucaucaccgacaccaucaagagcuggcggaacaacauccugcgcacccaggaguccgagugcgccugcgugaacggcagcugcuucacggucaugaccgacgggccguccaacggccaggccagcuacaagaucuucaagauggagaagggcaagguggugaaguccgccgagcucaacgcccccaacuaccacuacgaggagugcagcugcuaccccgacgcgggggagaucaucugcgucugccgggacaacuggcacggcuccaaccgccccugggugagcuucaaccagaaccuggaguaccagaucggguacaucugcuccggcguguucggggacaacccgcggcccaacgacggcaccggcagcugcgggcccgucucccccaacggcgccuacgggaucaagggcuucagcuucaaguacgggaacggcguguggaucggccgcaccaaguccacgaacagccgguccggguucgagaugaucugggacccgaacggcuggaccgggaccgacagcaacuucuccaugaagcaggacaucguggccaucaccgaguggagcggcuacagcggguccuucguccagcaccccgagcugacgggccucgacugcauccgccccugcuucuggguggagcugauccggggccgccccaaggagagcaccaucuggaccuccgggagcuccaucagcuucugcggcgucaacuccgacaccgugagcugguccuggccggacggggccgagcugcccuucacgaucgacaaguga

SEQ ID NO: 82082 - RNA, 1350 nt, Artificial Sequence
  derived and/or modified sequence opt1 from neuraminidase__InfluenzaA__AEO89302
augaaccccaaccagaagaucaucaccaucggcagcaucugcauggugaucgggaucgucucccugaugcuccagaucggcaacaucaucagcaucugggugucccacagcauccagaccgggaaccagcaccaggacgagccgauccgcaacgccaacuuccugacggagaacgccguggcguccgucacccuggccggcaacagcucccucugccccgugcgggggugggccgugcacagcaaggacaacuccauccgcaucggcagcaagggcgacgucuucgugauccgggagcccuucaucuccugcagccaccuggagugccgcaccuucuuccugacccagggggcccuccugaacgacaagcacuccaacggcacggugaaggaccggagcccccaccgcacccugauguccugcccggucggggaggcccccagccccuacaacucccgguucgagagcguggcgugguccgccagcgccugccacgacggcaccagcuggcucaccaucgggaucuccggccccgacaacggcgccguggcgguccugaaguacaacgggaucaucacggacaccaucaagagcuggcgcaacaacauccugcggacccaggaguccgagugcgccugcgugaacggcagcugcuucaccgugaugacggacgggccguccaacggccaggccagcuacaagaucuucaagauggagaagggcaaggucgugcgcuccguggagcucaacgcccccaacuaccacuacgaggagugcagcugcuaccccgacgccggggagaucacgugcgucugccgggacaacuggcacggcuccaaccgccccugggugagcuucaaccagaaccuggaguaccagaucggguacaucugcuccggcguguucggggacaacccgcggcccaacgacggcaccggcagcugcgaccccgucucccccaacggggcguacggcaucaagggguucagcuucaaguacggcaacgggguguggaucggccgcaccaaguccaccaacagccgguccggcuucgagaugaucugggacccgaacggguggaccgagaccgacagcgacuucuccgugaagcaggacaucgucgccaucaccgacuggagcggcuacagcggguccuucgugcagcaccccgagcugacgggccucgacugcauccgccccugcuucugggucgagcugauccgggggcgccccaaggagagcaccaucuggaccuccggcagcuccaucagcuucugcggcguguccagcgacaccguguccuggagcuggccggacggggccgagcugcccuucacgaucgacaaguga

SEQ ID NO: 82083 - RNA, 1410 nt, Artificial Sequence; identical to SEQ ID NO: 77065
  derived and/or modified sequence opt1 from neuraminidase__InfluenzaA__AEO99218

SEQ ID NO: 82084 - RNA, 1410 nt, Artificial Sequence
  derived and/or modified sequence opt1 from neuraminidase__InfluenzaA__AEQ49739
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgaggugaccugcgugugccgggacaacuggcacggcagcaaccgccccugggucuccuucaaccagaaccucgaguaccagaucggguacaucugcagcggcaucuucggggacaacccgcggcccaacgacaagacgggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggcauggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 82085 - RNA, 1410 nt, Artificial Sequence; identical to SEQ ID NO: 81265
  derived and/or modified sequence opt1 from neuraminidase__InfluenzaA__AEQ49740

SEQ ID NO: 82086 - RNA, 1410 nt, Artificial Sequence
  derived and/or modified sequence opt1 from neuraminidase__InfluenzaA__AEQ49741
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 82087 - RNA, 1410 nt, Artificial Sequence
  derived and/or modified sequence opt1 from neuraminidase__InfluenzaA__AEQ49742
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccauccacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 82088 - RNA, 1410 nt, Artificial Sequence
  derived and/or modified sequence opt1 from neuraminidase__InfluenzaA__AEQ49743
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggacgaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaacuga

SEQ ID NO: 82089 - RNA, 1410 nt, Artificial Sequence
  derived and/or modified sequence opt1 from neuraminidase__InfluenzaA__AEQ49744
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccucgucaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcugaccaucggcaucagcggccccgacaacggggccgucgccgugcucaaguacaacggcaucaucaccgacaccaucaaguccuggcgcaacaacaucuuccggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccaggaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcagaacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82090 - RNA, 1410 nt, Artificial Sequence; identical to SEQ ID NO: 82086
  derived and/or modified sequence opt1 from neuraminidase__InfluenzaA__AEQ49745

SEQ ID NO: 82091 - RNA, 1410 nt, Artificial Sequence; identical to SEQ ID NO: 82086
  derived and/or modified sequence opt1 from neuraminidase__InfluenzaA__AEQ49746

SEQ ID NO: 82092 - RNA, 1410 nt, Artificial Sequence; identical to SEQ ID NO: 82086
  derived and/or modified sequence opt1 from neuraminidase__InfluenzaA__AEQ49747

SEQ ID NO: 82093 - RNA, 1410 nt, Artificial Sequence; identical to SEQ ID NO: 81265
  derived and/or modified sequence opt1 from neuraminidase__InfluenzaA__AEQ49748

SEQ ID NO: 82094 - RNA, 1410 nt, Artificial Sequence; identical to SEQ ID NO: 82086
  derived and/or modified sequence opt1 from neuraminidase__InfluenzaA__AEQ49749

SEQ ID NO: 82095 - RNA, 1410 nt, Artificial Sequence
  derived and/or modified sequence opt1 from neuraminidase__InfluenzaA__AEQ49750
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaaccacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagaacaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82096 - RNA, 1410 nt, Artificial Sequence
  derived and/or modified sequence opt1 from neuraminidase__InfluenzaA__AEQ49751
augaaccccaaccagaagaucaucaccaucggcagcgugugcaugaccaucgggauggccaaccugauccuccagaucggcaacaucaucuccaucuggaucagccacuccuuccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaaccacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 82097 - RNA, 1410 nt, Artificial Sequence
  derived and/or modified sequence opt1 from neuraminidase__InfluenzaA__AEQ49752
augaaccccaaccagaagaucaucaccaucggcagcgugugcaugaccaucgggauggccaaccugauccuccagaucggcaacaucaucuccaucuggaucagccacuccauccagcuggggaaccagagccagaucggcacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacagccgguucgaguccguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccaucaugaccgacggcccgagcgacgggcaggccuccuacaagaucuuccgcaucgagaagggcaagaucgucaagagcguggagaugaacgcccccaacuacuacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucagcuccaacggcgccaacggggugaagggcuucagcuucaaguacgggaacggcguguggaucggccgcaccaagagcaucuccagccggaagggguucgagaugaucugggaccccaacggcuggaccgggaccgacaacaacuucuccaucaagcaggacaucgucggcaucaacgaguggagcggguacuccggcagcuucgugcagcacccggagcugacgggcauggacugcauccgccccugcuucuggguggagcugauccgggggcgccccaaggagaacaccaucuggaccuccggcagcuccaucagcuucugcggggucaacuccgacaccgugggcuggagcuggcccgacggcgccgagcucccguucacgaucgacaaguga

SEQ ID NO: 82098 - RNA, 1410 nt, Artificial Sequence
  derived and/or modified sequence opt1 from neuraminidase__InfluenzaA__AEQ49753
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccguggacuggagcuggcccgacggggccgagcucccguucacgaucgacaaguga

SEQ ID NO: 82099 - RNA, 1410 nt, Artificial Sequence
  derived and/or modified sequence opt1 from neuraminidase__InfluenzaA__AEQ49754
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccaacaccgugggguggagcuggcccgacggcgccgagcugccguucacgaucgacaaguga

SEQ ID NO: 82100 - RNA, 1410 nt, Artificial Sequence; identical to SEQ ID NO: 82086
  derived and/or modified sequence opt1 from neuraminidase__InfluenzaA__AEQ49755

SEQ ID NO: 82101 - RNA, 1410 nt, Artificial Sequence
  derived and/or modified sequence opt1 from neuraminidase__InfluenzaA__AEQ49756
augaaccccaaccagaagaucaucaccaucggcagcgugugcaugaccaucgggauggccaaccugauccuccagaucggcaacaucaucuccaucuggaucagccacuccauccagcuggggaaccagagccaggucgagacgugcaaccaguccgugaucaccuacgagaacaacaccugggugaaccagaccuacgucaacaucagcaacacgaacuucgccgcgggccaguccguggugagcgucaagcuggccgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82102 - RNA, 1410 nt, Artificial Sequence; identical to SEQ ID NO: 82086
  derived and/or modified sequence opt1 from neuraminidase__InfluenzaA__AEQ49757

SEQ ID NO: 82103 - RNA, 1410 nt, Artificial Sequence
  derived and/or modified sequence opt1 from neuraminidase__InfluenzaA__AEQ49758
augaaccccaaccagaagaucaucaccaucggcagcgugugcaugaccaucgggauggccaaccugauccuccagaucggcaacaucaucuccaucuggaucagccacuccauccagcuggggaaccacagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacgggugggccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacacgaucuggaccuccgggagcuccaucagcuucugcggcgucaacuccgacaccgugggguggagcuggcccgacggcgcggagcugccguucaccaucgacaaguga

SEQ ID NO: 82104 - RNA, 1410 nt, Artificial Sequence; identical to SEQ ID NO: 82086
  derived and/or modified sequence opt1 from neuraminidase__InfluenzaA__AEQ49759

SEQ ID NO: 82105 - RNA, 1410 nt, Artificial Sequence; identical to SEQ ID NO: 82086
  derived and/or modified sequence opt1 from neuraminidase__InfluenzaA__AEQ49760

SEQ ID NO: 82106 - RNA, 1410 nt, Artificial Sequence
  derived and/or modified sequence opt1 from neuraminidase__InfluenzaA__AEQ49761
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucagcgugaagcucgccgggaacuccagccugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacagcaacgggaccaucaaggaccggucccccuaccgcacgcugaugagcugcccgaucggcgaggugcccagccccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgcagcaaggagaacaccaucuggaccuccgggagcuccaucagcuucugcggcgugaacuccgacaccgucggguggagcuggcccgacggcgccgagcugcccuucacgaucgacaaguga

SEQ ID NO: 82107 - RNA, 1410 nt, Artificial Sequence
  derived and/or modified sequence opt1 from neuraminidase__InfluenzaA__AEQ49762
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaucaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugaccggccuggacugcauccgccccugcuucuggguggagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 82108 - RNA, 1410 nt, Artificial Sequence; identical to SEQ ID NO: 82086
  derived and/or modified sequence opt1 from neuraminidase__InfluenzaA__AEQ49763

SEQ ID NO: 82109 - RNA, 1410 nt, Artificial Sequence; identical to SEQ ID NO: 82086
  derived and/or modified sequence opt1 from neuraminidase__InfluenzaA__AEQ49764

SEQ ID NO: 82110 - RNA, 1410 nt, Artificial Sequence; identical to SEQ ID NO: 82086
  derived and/or modified sequence opt1 from neuraminidase__InfluenzaA__AEQ49765

SEQ ID NO: 82111 - RNA, 1410 nt, Artificial Sequence
  derived and/or modified sequence opt1 from neuraminidase__InfluenzaA__AEQ49766
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcugaccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 82112 - RNA, 1410 nt, Artificial Sequence
  derived and/or modified sequence opt1 from neuraminidase__InfluenzaA__AEQ49767
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuacaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggagcggcuacuccgggagcuucgugcagcacccggagcugacgggcaugggcugcauccggcccugcuucuggguggagcugauccgcgggcggcccaaggagaacaccaucuggaccuccggcagcuccaucagcuucugcggggucaacuccgacaccgugggcuggagcuggcccgacggcgccgagcucccguucacgaucgacaaguga

SEQ ID NO: 82113 - RNA, 1410 nt, Artificial Sequence; identical to SEQ ID NO: 81265
  derived and/or modified sequence opt1 from neuraminidase__InfluenzaA__AEQ49768

SEQ ID NO: 82114 - RNA, 1410 nt, Artificial Sequence; identical to SEQ ID NO: 82086
  derived and/or modified sequence opt1 from neuraminidase__InfluenzaA__AEQ49769

SEQ ID NO: 82115 - RNA, 1410 nt, Artificial Sequence
  derived and/or modified sequence opt1 from neuraminidase__InfluenzaA__AEQ49770
augaaccccaaccagaagaucaucaccaucggcagcgugugcaugaccaucgggauggccaaccugauccuccagaucggcaacaucaucuccgucuggaucagccacuccauccagcuggggaaccagaaccagacggagaccugcaaccagagcgugaucaccuacgagaacaacaccugggugaaccagacguacgucaacaucuccaacaccaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcacggacaacaacuucagcaucaagcaggacaucaucgggaucaacgagugguccggcuacagcggguccuucgugcagcacccggagcugaccggccuggacugcauccggcccugcuucugggucgagcucauccgcggccggcccaaggagaacaccaucuggaccagcggguccagcaucuccuucugcggcgugaacagcgacacggucgggugguccuggcccgacggcgccgagcugccguucaccguggacaaguga

SEQ ID NO: 82116 - RNA, 1410 nt, Artificial Sequence; identical to SEQ ID NO: 82099
  derived and/or modified sequence opt1 from neuraminidase__InfluenzaA__AEQ49771

SEQ ID NO: 82117 - RNA, 1410 nt, Artificial Sequence; identical to SEQ ID NO: 81265
  derived and/or modified sequence opt1 from neuraminidase__InfluenzaA__AEQ49772

SEQ ID NO: 82118 - RNA, 1410 nt, Artificial Sequence
  derived and/or modified sequence opt1 from neuraminidase__InfluenzaA__AEQ49773
augaaccccaaccagaagaucaucaccaucggcagcaucugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccaacaccgucggguggagcuggcccgacggcgccgagcugccguucacgaucgacaaguga

SEQ ID NO: 82119 - RNA, 1410 nt, Artificial Sequence
  derived and/or modified sequence opt1 from neuraminidase__InfluenzaA__AEQ49774
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgaguacaacaccugggugaaccagaccuacaucaacaucagcaacacgaacuucgccgcgggccaguccguggucagcgugaagcugguggggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuacgagaugaucugggaccccaacggguggaccggcaccgacaacaacuucuccaucaagcaggacaucgucgggaucaacgaguggagcggcuacuccgggagcuucgugcagcacccggagcugacgggcauggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 82120 - RNA, 1410 nt, Artificial Sequence; identical to SEQ ID NO: 81265
  derived and/or modified sequence opt1 from neuraminidase__InfluenzaA__AEQ49775

SEQ ID NO: 82121 - RNA, 1410 nt, Artificial Sequence
  derived and/or modified sequence opt1 from neuraminidase__InfluenzaA__AEQ49776
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagccccuccgagugccgcaccuucuuccugacccagggcgcccugcucaacgacaagcacagcaacgggaccaucaaggaccggucccccuaccgcacgcugaugagcugcccgaucggcgagguccccagccccuacaacucccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaccgagaacaccaucuggaccagcggguccagcaucuccuucugcggcgucaacagcgacacgguggggugguccuggcccgacggcgccgagcucccguucaccaucgacaaguga

SEQ ID NO: 82122 - RNA, 1410 nt, Artificial Sequence; identical to SEQ ID NO: 82086
  derived and/or modified sequence opt1 from neuraminidase__InfluenzaA__AEQ49777

SEQ ID NO: 82123 - RNA, 1410 nt, Artificial Sequence
  derived and/or modified sequence opt1 from neuraminidase__InfluenzaA__AEQ49778
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggaucaaccagaccuacgugaacaucagcaacacgaacuucgccgcggugcaguccgucgugagcgugaagcuggccggcaacuccacccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcacgaucaaggaccggucccccuaccgcacccugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacacgaucaagagcuggcgcaacaacauccugcggacccaggaguccgagugcgcgugcgugaacggcagcugcuucaccaucaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaagggcuucgagaugaucugggaccccaacggcuggaccgggacggacaacaacuucagcaucaagcaggacaucgucggcaucaacgagugguccggguacagcggcuccuucgugcagcacccggagcugaccgggcuggacugcauccgccccugcuucuggguggagcucauccggggccgccccaaggagaacaccaucuggaccagcggcuccagcaucuccuucugcggggucaacagcgacacggugggcugguccuggcccgacggggccgagcugccguucaccaucgacaaguga

SEQ ID NO: 82124 - RNA, 1410 nt, Artificial Sequence
  derived and/or modified sequence opt1 from neuraminidase__InfluenzaA__AEQ49779
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacagcggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccgucgacaaguga

SEQ ID NO: 82125 - RNA, 1410 nt, Artificial Sequence; identical to SEQ ID NO: 81265
  derived and/or modified sequence opt1 from neuraminidase__InfluenzaA__AEQ49780

SEQ ID NO: 82126 - RNA, 1410 nt, Artificial Sequence; identical to SEQ ID NO: 81265
  derived and/or modified sequence opt1 from neuraminidase__InfluenzaA__AEQ49781

SEQ ID NO: 82127 - RNA, 1410 nt, Artificial Sequence; identical to SEQ ID NO: 82086
  derived and/or modified sequence opt1 from neuraminidase__InfluenzaA__AEQ49782

SEQ ID NO: 82128 - RNA, 1410 nt, Artificial Sequence
  derived and/or modified sequence opt1 from neuraminidase__InfluenzaA__AEQ49783
augaaccccaaccagaagaucaucaccaucggcagcgccugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgcggccggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggagcgccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 82129 - RNA, 1410 nt, Artificial Sequence
  derived and/or modified sequence opt1 from neuraminidase__InfluenzaA__AEQ49785
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 82130 - RNA, 1410 nt, Artificial Sequence; identical to SEQ ID NO: 82129
  derived and/or modified sequence opt1 from neuraminidase__InfluenzaA__AEQ49786

SEQ ID NO: 82131 - RNA, 1410 nt, Artificial Sequence; identical to SEQ ID NO: 82129
  derived and/or modified sequence opt1 from neuraminidase__InfluenzaA__AEQ49788

SEQ ID NO: 82132 - RNA, 1410 nt, Artificial Sequence; identical to SEQ ID NO: 82129
  derived and/or modified sequence opt1 from neuraminidase__InfluenzaA__AEQ49789

SEQ ID NO: 82133 - RNA, 1410 nt, Artificial Sequence
  derived and/or modified sequence opt1 from neuraminidase__InfluenzaA__AEQ49790
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggccggacggggccgaccugaaccucaugcccaucuga

SEQ ID NO: 82134 - RNA, 1410 nt, Artificial Sequence
  derived and/or modified sequence opt1 from neuraminidase__InfluenzaA__AEQ49791
augaaccccaaccagaagaucaucaccaucggcagcgugucccugaccaucagcacgaucugcuucuucaugcagaucgccauccucaucaccaccgucacccugcacuucaagcaguacgaguucuacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcaaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaacccgaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcacguccgggaccuacggcaccgggagcuggcccgacggcgccgaccugaaccucaugcccaucuga

SEQ ID NO: 82135 - RNA, 1410 nt, Artificial Sequence; identical to SEQ ID NO: 82129
  derived and/or modified sequence opt1 from neuraminidase__InfluenzaA__AEQ49792

SEQ ID NO: 82136 - RNA, 1410 nt, Artificial Sequence; identical to SEQ ID NO: 82129
  derived and/or modified sequence opt1 from neuraminidase__InfluenzaA__AEQ49793

SEQ ID NO: 82137 - RNA, 1410 nt, Artificial Sequence; identical to SEQ ID NO: 82129
  derived and/or modified sequence opt1 from neuraminidase__InfluenzaA__AEQ49794

SEQ ID NO: 82138 - RNA, 1410 nt, Artificial Sequence; identical to SEQ ID NO: 82129
  derived and/or modified sequence opt1 from neuraminidase__InfluenzaA__AEQ49795

SEQ ID NO: 82139 - RNA, 1410 nt, Artificial Sequence
  derived and/or modified sequence opt1 from neuraminidase__InfluenzaA__AEQ49796
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagagcaagcugcagaucaaccgccaggugaucguggacaaggggaaccgguccggcuacagcgggaucuucuccgucgagggcaagagcugcaucaaccgcugcuucuacguggagcucauccggggccgcaaggaggagaccgaggugcuguggaccagcaacuccaucgucguguucugcgggacgagcggcaccuacgggaccggcuccuggccggacggggccgaccugaaccucaugcccaucuga

SEQ ID NO: 82140 - RNA, 1410 nt, Artificial Sequence; identical to SEQ ID NO: 82129
  derived and/or modified sequence opt1 from neuraminidase__InfluenzaA__AEQ49797

SEQ ID NO: 82141 - RNA, 1410 nt, Artificial Sequence; identical to SEQ ID NO: 82129
  derived and/or modified sequence opt1 from neuraminidase__InfluenzaA__AEQ49798

SEQ ID NO: 82142 - RNA, 1410 nt, Artificial Sequence; identical to SEQ ID NO: 82129
  derived and/or modified sequence opt1 from neuraminidase__InfluenzaA__AEQ49799

SEQ ID NO: 82143 - RNA, 1410 nt, Artificial Sequence; identical to SEQ ID NO: 82129
  derived and/or modified sequence opt1 from neuraminidase__InfluenzaA__AEQ49800

SEQ ID NO: 82144 - RNA, 1410 nt, Artificial Sequence; identical to SEQ ID NO: 82129
  derived and/or modified sequence opt1 from neuraminidase__InfluenzaA__AEQ49801

SEQ ID NO: 82145 - RNA, 1410 nt, Artificial Sequence; identical to SEQ ID NO: 82129
  derived and/or modified sequence opt1 from neuraminidase__InfluenzaA__AEQ49802

SEQ ID NO: 82146 - RNA, 1410 nt, Artificial Sequence
  derived and/or modified sequence opt1 from neuraminidase__InfluenzaA__AEQ49803
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccaccagcuccagccacugccucgaccccaacaacgaggagggcgggcacggggucaagggcugggccuucgacgacgggaacgacguguggaugggccgcaccaucuccgagaccagccggcugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgaccugaaccucaugacgaucuga

SEQ ID NO: 82147 - RNA, 1410 nt, Artificial Sequence
  derived and/or modified sequence opt1 from neuraminidase__InfluenzaA__AEQ49804
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggacauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 82148 - RNA, 1410 nt, Artificial Sequence
  derived and/or modified sequence opt1 from neuraminidase__InfluenzaA__AEQ49805
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcaaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggacauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 82149 - RNA, 1410 nt, Artificial Sequence
  derived and/or modified sequence opt1 from neuraminidase__InfluenzaA__AEQ49806
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccuucagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcacguccgggaccuacggcaccgggagcuggccggacggcgccgaccugaaccucaugcccaucuga

SEQ ID NO: 82150 - RNA, 1410 nt, Artificial Sequence; identical to SEQ ID NO: 80526
  derived and/or modified sequence opt1 from neuraminidase__InfluenzaA__AEQ49807

SEQ ID NO: 82151 - RNA, 1410 nt, Artificial Sequence
  derived and/or modified sequence opt1 from neuraminidase__InfluenzaA__AEQ49809
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82152 - RNA, 1410 nt, Artificial Sequence; identical to SEQ ID NO: 82151
  derived and/or modified sequence opt1 from neuraminidase__InfluenzaA__AEQ49811

SEQ ID NO: 82153 - RNA, 1410 nt, Artificial Sequence; identical to SEQ ID NO: 80526
  derived and/or modified sequence opt1 from neuraminidase__InfluenzaA__AEQ49812

SEQ ID NO: 82154 - RNA, 1410 nt, Artificial Sequence; identical to SEQ ID NO: 80526
  derived and/or modified sequence opt1 from neuraminidase__InfluenzaA__AEQ49813

SEQ ID NO: 82155 - RNA, 1410 nt, Artificial Sequence; identical to SEQ ID NO: 80526
  derived and/or modified sequence opt1 from neuraminidase__InfluenzaA__AEQ49815

SEQ ID NO: 82156 - RNA, 1410 nt, Artificial Sequence
  derived and/or modified sequence opt1 from neuraminidase__InfluenzaA__AEQ49816
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucguggaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaugaaggaccacuccaucgugagcuccuacgugugcagcggccuggucggcgacacgccccggaagaacgacuccagcuccagcucccacugcuucgaccccaacgacgaggagggcgggcacggggugaagggcugggccuucgacgacgggaacgacgucuggaugggccgcaccaucagcgagaagucccggcucggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcugauccgcgggcggaaggaggagaccgagguccucuggaccuccaacagcaucgugguguucugcggcaccuccgggacguacggcaccgggagcuggccggacggcgccgacaucaaccugaugcccaucuga

SEQ ID NO: 82157 - RNA, 1410 nt, Artificial Sequence; identical to SEQ ID NO: 81891
  derived and/or modified sequence opt1 from neuraminidase__InfluenzaA__AEQ49820

SEQ ID NO: 82158 - RNA, 1410 nt, Artificial Sequence; identical to SEQ ID NO: 81891
  derived and/or modified sequence opt1 from neuraminidase__InfluenzaA__AEQ49821

SEQ ID NO: 82159 - RNA, 1410 nt, Artificial Sequence; identical to SEQ ID NO: 82129
  derived and/or modified sequence opt1 from neuraminidase__InfluenzaA__AEQ49822

SEQ ID NO: 82160 - RNA, 1410 nt, Artificial Sequence; identical to SEQ ID NO: 82129
  derived and/or modified sequence opt1 from neuraminidase__InfluenzaA__AEQ49823

SEQ ID NO: 82161 - RNA, 1410 nt, Artificial Sequence; identical to SEQ ID NO: 82129
  derived and/or modified sequence opt1 from neuraminidase__InfluenzaA__AEQ49824

SEQ ID NO: 82162 - RNA, 1410 nt, Artificial Sequence; identical to SEQ ID NO: 82129
  derived and/or modified sequence opt1 from neuraminidase__InfluenzaA__AEQ49825

SEQ ID NO: 82163 - RNA, 1410 nt, Artificial Sequence; identical to SEQ ID NO: 82129
  derived and/or modified sequence opt1 from neuraminidase__InfluenzaA__AEQ49826

SEQ ID NO: 82164 - RNA, 1410 nt, Artificial Sequence; identical to SEQ ID NO: 82129
  derived and/or modified sequence opt1 from neuraminidase__InfluenzaA__AEQ49827

SEQ ID NO: 82165 - RNA, 1410 nt, Artificial Sequence; identical to SEQ ID NO: 82129
  derived and/or modified sequence opt1 from neuraminidase__InfluenzaA__AEQ49828

SEQ ID NO: 82166 - RNA, 1410 nt, Artificial Sequence
  derived and/or modified sequence opt1 from neuraminidase__InfluenzaA__AEQ49829
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgcccucggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaugaaggaccacagcaucgucuccagcuacgugugcuccggccucgugggcgacacgccccggaagaacgacagcuccagcuccagccacugcuucgaccccaacgacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcgaccgcuccggguacagcggcaucuucuccgucgagggcaagagcugcaucaaccggugcuucuacguggagcucauccgcgggagcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82167 - RNA, 1410 nt, Artificial Sequence; identical to SEQ ID NO: 82129
  derived and/or modified sequence opt1 from neuraminidase__InfluenzaA__AEQ49830

SEQ ID NO: 82168 - RNA, 1410 nt, Artificial Sequence; identical to SEQ ID NO: 82129
  derived and/or modified sequence opt1 from neuraminidase__InfluenzaA__AEQ49831

SEQ ID NO: 82169 - RNA, 1410 nt, Artificial Sequence
  derived and/or modified sequence opt1 from neuraminidase__InfluenzaA__AEQ49832
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucguggagggguggagcaaccccaaguccaagcugcagaucaaccgccaggugaucgucgaccggggcgaccgcagcggguacuccggcaucuucagcguggagggcaagagcugcaucaaccggugcuucuacguggagcugauccgcggguccaaggaggagaccgagguccucuggaccagcaacuccaucgugguguucugcggcaccagcgggacguacggcaccggguccuggccggacggcgccgacaucaaccugaugcccaucuga

SEQ ID NO: 82170 - RNA, 1410 nt, Artificial Sequence
  derived and/or modified sequence opt1 from neuraminidase__InfluenzaA__AEQ49833
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucucccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 82171 - RNA, 1410 nt, Artificial Sequence
  derived and/or modified sequence opt1 from neuraminidase__InfluenzaA__AEQ49835
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 82172 - RNA, 1410 nt, Artificial Sequence; identical to SEQ ID NO: 82171
  derived and/or modified sequence opt1 from neuraminidase__InfluenzaA__AEQ49836

SEQ ID NO: 82173 - RNA, 1410 nt, Artificial Sequence; identical to SEQ ID NO: 82171
  derived and/or modified sequence opt1 from neuraminidase__InfluenzaA__AEQ49838

SEQ ID NO: 82174 - RNA, 1410 nt, Artificial Sequence; identical to SEQ ID NO: 82171
  derived and/or modified sequence opt1 from neuraminidase__InfluenzaA__AEQ49839

SEQ ID NO: 82175 - RNA, 1410 nt, Artificial Sequence
  derived and/or modified sequence opt1 from neuraminidase__InfluenzaA__AEQ49840
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugccgaucuga

SEQ ID NO: 82176 - RNA, 1410 nt, Artificial Sequence; identical to SEQ ID NO: 82171
  derived and/or modified sequence opt1 from neuraminidase__InfluenzaA__AEQ49841

SEQ ID NO: 82177 - RNA, 1410 nt, Artificial Sequence; identical to SEQ ID NO: 82171
  derived and/or modified sequence opt1 from neuraminidase__InfluenzaA__AEQ49842

SEQ ID NO: 82178 - RNA, 1410 nt, Artificial Sequence; identical to SEQ ID NO: 82171
  derived and/or modified sequence opt1 from neuraminidase__InfluenzaA__AEQ49843

SEQ ID NO: 82179 - RNA, 1410 nt, Artificial Sequence; identical to SEQ ID NO: 82129
  derived and/or modified sequence opt1 from neuraminidase__InfluenzaA__AEQ49844

SEQ ID NO: 82180 - RNA, 1410 nt, Artificial Sequence
  derived and/or modified sequence opt1 from neuraminidase__InfluenzaA__AEQ49845
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagcgggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccaacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaugaaggaccacuccaucgucagcuccuacgugugcagcggccuggugggcgacacgccccgcaagaacgacuccagcuccagcucccacugcuucgaccccaacgacgaggagggcgggcacggggucaagggcugggccuucgacgacgggaacgacguguggaugggccggaccaucagcgagaagucccgccucggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 82181 - RNA, 1410 nt, Artificial Sequence
  derived and/or modified sequence opt1 from neuraminidase__InfluenzaA__AEQ49846
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaaccugaaggaccacuccaucgucagcuccuacgugugcagcggccucgugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 82182 - RNA, 1410 nt, Artificial Sequence
  derived and/or modified sequence opt1 from neuraminidase__InfluenzaA__AEQ49850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaagaucaugcccaucuga

SEQ ID NO: 82183 - RNA, 1410 nt, Artificial Sequence
  derived and/or modified sequence opt1 from neuraminidase__InfluenzaA__AEQ49851
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucauggagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82184 - RNA, 1410 nt, Artificial Sequence; identical to SEQ ID NO: 82151
  derived and/or modified sequence opt1 from neuraminidase__InfluenzaA__AEQ49852

SEQ ID NO: 82185 - RNA, 1410 nt, Artificial Sequence; identical to SEQ ID NO: 82129
  derived and/or modified sequence opt1 from neuraminidase__InfluenzaA__AEQ49969

SEQ ID NO: 82186 - RNA, 1410 nt, Artificial Sequence; identical to SEQ ID NO: 82151
  derived and/or modified sequence opt1 from neuraminidase__InfluenzaA__AEQ49970

SEQ ID NO: 82187 - RNA, 1410 nt, Artificial Sequence
  derived and/or modified sequence opt1 from neuraminidase__InfluenzaA__AEQ54954
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaccucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 82188 - RNA, 1410 nt, Artificial Sequence; identical to SEQ ID NO: 77607
  derived and/or modified sequence opt1 from neuraminidase__InfluenzaA__AER08645

SEQ ID NO: 82189 - RNA, 1410 nt, Artificial Sequence
  derived and/or modified sequence opt1 from neuraminidase__InfluenzaA__AER08649
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagcuggugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 82190 - RNA, 1410 nt, Artificial Sequence
  derived and/or modified sequence opt1 from neuraminidase__InfluenzaA__AER08657
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaugugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 82191 - RNA, 1410 nt, Artificial Sequence; identical to SEQ ID NO: 77607
  derived and/or modified sequence opt1 from neuraminidase__InfluenzaA__AER08659

SEQ ID NO: 82192 - RNA, 1410 nt, Artificial Sequence
  derived and/or modified sequence opt1 from neuraminidase__InfluenzaA__AER08661
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggggaccacggcgucaaggggugggccuucgacgacggcaacgacguguggauggggcgcaccaucaacgagaccagccggcugggcuacgagaccuucaaggucaucgagggcugguccaaccccaagagcaagcugcagaucaaccgccaggugaucguggaccgggggaaccgcuccggcuacagcgggaucuucuccgucgagggcaagagcugcaucaaccggugcuucuacguggagcucauccgcgggcggaaggaggagaccgaggugcuguggaccagcaacuccaucgucguguucugcggcacgagcggcaccuacgggaccggcuccuggccggacggggccgaccugaaccucaugcccaucuga

SEQ ID NO: 82193 - RNA, 1410 nt, Artificial Sequence; identical to SEQ ID NO: 80526
  derived and/or modified sequence opt1 from neuraminidase__InfluenzaA__AER08663

SEQ ID NO: 82194 - RNA, 1410 nt, Artificial Sequence; identical to SEQ ID NO: 80526
  derived and/or modified sequence opt1 from neuraminidase__InfluenzaA__AER08665

SEQ ID NO: 82195 - RNA, 1410 nt, Artificial Sequence
  derived and/or modified sequence opt1 from neuraminidase__InfluenzaA__AER08669
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaccucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggacguccaacagcaucgucguguucugcggcaccuccgggaccuacggcaccgggagcuggccggacggcgccgaccugaaccucaugcccaucuga

SEQ ID NO: 82196 - RNA, 1410 nt, Artificial Sequence
  derived and/or modified sequence opt1 from neuraminidase__InfluenzaA__AER08671
augaaccccaaccagaagaucaucaccaucggcagcgugucccugaccaucagcacgaucugcuucuucaugcagaucgccauccucaucaccaccgucacccugcacuucaagcaguacggguucaacuccccgcccaacaaccaggugaugcugugcgagcccacgaucaucgagcgcaacaucaccgagaucguguaccucaccaacaccacgaucgagaaggagaucugccccacccuggccgaguaccggaacuggagcaagccgcagugcgacaucaccggcuucgcgcccuucuccaaggacaacagcauccgccuguccgccgggggcgacaucugggucacccgggagcccuacgugagcugcgaccccgacaagugcuaccaguucgcccucgggcagggcacgacccugaacaacgugcacuccaacaacaccguccgcgaccggaccccguaccgcacgcugcucaugaacgagcugggcgugcccuuccaccuggggaccaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacgcaggagagcgagugcgugugcaucaacgggaccugcaccguggucaugaccgacggcuccgccagcggcaaggccgacacgaagauccucuucaucgaggaggggaagaucgugcacaccagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggacgagcaacuccaucgucguguucugcgggaccagcggcaccuacgggaccggcuccuggccggacggggccgaccugaaccucaugcccaucuga

SEQ ID NO: 82197 - RNA, 1410 nt, Artificial Sequence; identical to SEQ ID NO: 80526
  derived and/or modified sequence opt1 from neuraminidase__InfluenzaA__AER08673

SEQ ID NO: 82198 - RNA, 1410 nt, Artificial Sequence; identical to SEQ ID NO: 80526
  derived and/or modified sequence opt1 from neuraminidase__InfluenzaA__AER08675

SEQ ID NO: 82199 - RNA, 1410 nt, Artificial Sequence; identical to SEQ ID NO: 80526
  derived and/or modified sequence opt1 from neuraminidase__InfluenzaA__AER08677

SEQ ID NO: 82200 - RNA, 1410 nt, Artificial Sequence; identical to SEQ ID NO: 80526
  derived and/or modified sequence opt1 from neuraminidase__InfluenzaA__AER08679

SEQ ID NO: 82201 - RNA, 1410 nt, Artificial Sequence
  derived and/or modified sequence opt1 from neuraminidase__InfluenzaA__AER08681
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacgacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82202 - RNA, 1410 nt, Artificial Sequence; identical to SEQ ID NO: 80526
  derived and/or modified sequence opt1 from neuraminidase__InfluenzaA__AER08683

SEQ ID NO: 82203 - RNA, 1410 nt, Artificial Sequence; identical to SEQ ID NO: 82151
  derived and/or modified sequence opt1 from neuraminidase__InfluenzaA__AER08685

SEQ ID NO: 82204 - RNA, 1410 nt, Artificial Sequence; identical to SEQ ID NO: 82151
  derived and/or modified sequence opt1 from neuraminidase__InfluenzaA__AER08687

SEQ ID NO: 82205 - RNA, 1410 nt, Artificial Sequence
  derived and/or modified sequence opt1 from neuraminidase__InfluenzaA__AER08689
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugacgcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaaggacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgaccugaaccucaugcccaucuga

SEQ ID NO: 82206 - RNA, 1410 nt, Artificial Sequence; identical to SEQ ID NO: 82151
  derived and/or modified sequence opt1 from neuraminidase__InfluenzaA__AER08691

SEQ ID NO: 82207 - RNA, 1410 nt, Artificial Sequence
  derived and/or modified sequence opt1 from neuraminidase__InfluenzaA__AER08693
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaagaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82208 - RNA, 1410 nt, Artificial Sequence
  derived and/or modified sequence opt1 from neuraminidase__InfluenzaA__AER08697
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccacccuggccgaguaccggaacuggagcaagccgcagugcgacaucaccggguucgcgcccuucuccaaggacaacagcauccgccuguccgccggcggggacaucugggucacgcgggagcccuacgugagcugcgaccccgacaagugcuaccaguucgcccucggccaggggaccacccugaacaacgugcacuccaacaacaccguccgcgaccggacgccguaccgcacccugcucaugaacgagcugggcgugcccuuccaccugggcaccaagcaggucugcaucgccuggagcuccagcuccugccacgacgggaaggccuggcuccacgugugcaucaccggcgacgacaagaacgcgacggccagcuucaucuacaacgggcggcugguggacuccguggucagcugguccaaggagauccugcgcacccaggagagcgagugcgugugcaucaacgggaccugcaccguggucaugacggacggguccgccagcggcaaggccgacaccaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgucaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagacggagguccuguggaccagcaacuccaucgugguguucugcggcaccagcgggaccuacggcacgggguccuggccggacggcgccgaccugaaccucaugcccaucuga

SEQ ID NO: 82209 - RNA, 1410 nt, Artificial Sequence; identical to SEQ ID NO: 82005
  derived and/or modified sequence opt1 from neuraminidase__InfluenzaA__AER92714

SEQ ID NO: 82210 - RNA, 1410 nt, Artificial Sequence; identical to SEQ ID NO: 77746
  derived and/or modified sequence opt1 from neuraminidase__InfluenzaA__AER92721

SEQ ID NO: 82211 - RNA, 1410 nt, Artificial Sequence; identical to SEQ ID NO: 77746
  derived and/or modified sequence opt1 from neuraminidase__InfluenzaA__AER92724

SEQ ID NO: 82212 - RNA, 1413 nt, Artificial Sequence
  derived and/or modified sequence opt1 from neuraminidase__InfluenzaA__AET84165
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucuccgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccaucgacggcgcgaacggggugaagggcuucuccuacaaguacggcaacggggucuggaucggccgcaccaagagcaaccggcugcgcaagggguucgagaugaucugggaccccaacggcuggacgaacaccgacuccgacuucagcgugaagcaggacguggucgccaucaccgacuggagcggguacuccggcagcuucgugcagcaccccgagcucacgggccuggacugcauccggcccugcuucuggguggagcugguccgcgggcucccgcgggagaacaccaccaucuggaccuccggcagcuccaucagcuucugcggggugaacuccgacacggccaacuggagcuggcccgacggcgccgagcugcccuucaccaucgacaaguga

SEQ ID NO: 82213 - RNA, 1413 nt, Artificial Sequence; identical to SEQ ID NO: 79938
  derived and/or modified sequence opt1 from neuraminidase__InfluenzaA__AET84176

SEQ ID NO: 82214 - RNA, 1413 nt, Artificial Sequence
  derived and/or modified sequence opt1 from neuraminidase__InfluenzaA__AET84187
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcauggacuggcucaccaucggcaucagcgggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcagcaaccgccccuggguguccuucaaccagaaccuggacuaccagaucggguacaucugcagcggcgucuucggcgacaacccccggcccaaggacggggagggcuccugcaacccggugaccaucgacggggcgaacggcgugaagggguucagcuacaaguacggcaacggcgucuggaucgggcgcacgaaguccaaccggcugcgcaagggcuucgagaugaucugggaccccaacggguggaccaacaccgacagcgacuucuccgugaagcaggacguggucgccaucaccgacuggagcggcuacagcggguccuucgugcagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 82215 - RNA, 1413 nt, Artificial Sequence
  derived and/or modified sequence opt1 from neuraminidase__InfluenzaA__AET84198
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 82216 - RNA, 1413 nt, Artificial Sequence
  derived and/or modified sequence opt1 from neuraminidase__InfluenzaA__AET84209
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaaggugguggcgggggaggacaagaccagcgucacccuggccggcaacuccagccugugcuccaucagcggcugggccaucaacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 82217 - RNA, 1413 nt, Artificial Sequence
  derived and/or modified sequence opt1 from neuraminidase__InfluenzaA__AET84231
augaaccccaaccagaagaucaucaccaucggcagcaucuccaucgccaucgggaucaucagccugaugcuccagaucggcuccaucaucagcaucugggccucccacagcauccacaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccagcuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgccaacggggucaagggcuucagcuacaaguacggcaacgggguguggaucggccgcacgaaguccaaccggcugcgcaagggguucgagaugaucugggaccccaacggcuggaccaacaccgacagcgacuucagcgugaagcaggacgucguggcgaucaccgacugguccggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 82218 - RNA, 1413 nt, Artificial Sequence; identical to SEQ ID NO: 78469
  derived and/or modified sequence opt1 from neuraminidase__InfluenzaA__AET84242

SEQ ID NO: 82219 - RNA, 1413 nt, Artificial Sequence
  derived and/or modified sequence opt1 from neuraminidase__InfluenzaA__AET84253
augaaccccaaccagaagaucaucaccaucggcagcaucuccaucgccaucgggaucaucagccugaugcuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcaugaacggcagcugcuucaccaucaugacggacgggcccuccaacaaggccgccagcuacaagaucuucaagaucgagaagggcaaggugaccaaguccaucgagcucaacgcccccaacuucuacuacgaggagugcagcugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacggcaacggcguguggaucgggcgcaccaagagcaaccggcugcgcaagggcuucgagaugaucugggaccccaacggguggacgaacaccgacuccgacuucagcgugaagcaggacgucguggccaucaccgacuggagcggcuacuccgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 82220 - RNA, 1413 nt, Artificial Sequence
  derived and/or modified sequence opt1 from neuraminidase__InfluenzaA__AET84264
augaaccccaaccagaagaucaucaccaucggcagcaucuccaucgccaucgggaucaucagccugauguuccagaucggcuccaucaucagcaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccucgccggcaacagcucccugugcagcaucuccggcugggccaucuacaccaaggacaacagcauccggaucggguccaagggcgacguguucgugauccgcgagccguucaucagcugcucccaccuggagugccggacguucuuccucacccagggggcccugcugaacgacaagcacagcaacggcaccgucaaggaccgcucccccuaccgggcccucaugagcugcccccugggggaggcgcccagcccguacaacuccaaguucgagagcguggccugguccgccagcgccugccacgacggcaugggcuggcugaccaucgggaucuccggccccgacaacggggcgguggccguccucaaguacaacggcaucaucacggagaccaucaagagcuggaagaagcagauccugcgcacccaggaguccgagugcgugugcaugaacggcagcugcuucaccaucaugacggacgggcccuccaacaaggccgccagcuacaagaucuucaagaucgagaagggcaaggugaccaaguccaucgagcugaacgcccccaacuucuacuacgaggagugcagcugcuacccggacaccgggaucgucaugugcgugugccgggacaacuggcacggcuccaaccgccccugggugagcuucaaccagaaccucgacuaccagaucggguacaucugcuccggcgucuucggcgacaacccccggcccgaggacggggagggcagcugcaacccggugaccguggacggggcgaacggcgucaagggguucuccuacaaguacggcaacggcguguggaucgggcgcaccaagagcaaccggcugcgcaagggcuucgagaugaucugggaccccaacggguggacgaacaccgacuccgacuucagcgugaagcaggacgucguggccaucaccgacuggagcggcuacuccgggagcuucgugcagcaccccgagcugacgggccucgacugcauccggcccugcuucugggucgagcuggugcgcggccugccgcgggagaacaccaccaucuggaccuccgggagcuccaucagcuucugcggcgucaacuccgacacggccaacuggagcuggcccgacggggccgagcuccccuucaccaucgacaaguga

SEQ ID NO: 82221 - RNA, 1413 nt, Artificial Sequence
  derived and/or modified sequence opt1 from neuraminidase__InfluenzaA__AET84275
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 82222 - RNA, 1413 nt, Artificial Sequence; identical to SEQ ID NO: 78469
  derived and/or modified sequence opt1 from neuraminidase__InfluenzaA__AET84286

SEQ ID NO: 82223 - RNA, 1413 nt, Artificial Sequence
  derived and/or modified sequence opt1 from neuraminidase__InfluenzaA__AET84297
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacgaccaacugguccuggcccgacggggccgagcugcccuucaccaucgacaaguga

SEQ ID NO: 82224 - RNA, 1413 nt, Artificial Sequence
  derived and/or modified sequence opt1 from neuraminidase__InfluenzaA__AET84308
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggguacaucugcagcggcgucuucggcgacaacccccggcccgaggacggggagggcuccugcaacccggugaccguggacggggcgaacggcgucaagggguucagcuacaaguacgacaacggcguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacggggcuggacugcauccggcccugcuucugggucgagcuggugcgcggccucccgcgggagaacaccaccaucuggaccagcggcuccagcaucuccuucugcggggucaacagcgacacgaccaacugguccuggcccgacggcgccgagcugcccuucaccaucgacaaguga

SEQ ID NO: 82225 - RNA, 1413 nt, Artificial Sequence
  derived and/or modified sequence opt1 from neuraminidase__InfluenzaA__AET84319
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaaccgcaccgugaaggaccggagccccuaccgcgcccugauguccugcccccugggcgaggcgcccagcccguacaacagcaaguucgaguccgucgccuggagcgccuccgccugccacgacgggaugggcuggcucaccaucggcaucagcgggcccgacaacggcgcgguggccgugcugaaguacaacgggaucaucacggagaccaucaaguccuggaagaagcagauccugcggacccaggagagcgagugcgucugcaugaacggcuccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgcgacaacuggcacgggagcaaccggcccuggguguccuucaaccagaaccuggacuaccagaucggcuacaucugcagcgggguguucggcgacaacccccgccccgaggacggcgagggguccugcaacccggucaccguggacggcgcgaacggggugaagggcuucagcuacaaguacgggaacggcgucuggaucggccggacgaaguccaaccgccugcggaagggguucgagaugaucugggaccccaacggcuggaccaacaccgacagcgacuucuccgugaagcaggacguggucgccaucaccgacuggagcggguacagcggcuccuucgugcagcaccccgagcucacggggcuggacugcauccgccccugcuucuggguggagcugguccggggccucccgcgcgagaacaccaccaucuggaccagcggcuccagcaucuccuucugcggggugaacagcgacacggccaacugguccuggcccgacggcgccgagcugcccuucaccaucgacaaguga

SEQ ID NO: 82226 - RNA, 1413 nt, Artificial Sequence
  derived and/or modified sequence opt1 from neuraminidase__InfluenzaA__AET84330
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagagcgagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacagcgacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccagcggcuccagcaucuccuucugcggggugaacagcgacaccgccaacugguccuggcccgacggcgccgagcugcccuucacgaucgacaaguga

SEQ ID NO: 82227 - RNA, 1413 nt, Artificial Sequence
  derived and/or modified sequence opt1 from neuraminidase__InfluenzaA__AET84341
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagagcgagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggagcaaccggcccuggguguccuucaaccagaaccuggacuaccagaucggcuacaucugcagcggcguguucggggacaacccccgccccaaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacagcgacuucuccgugaagcaggacguggucgccaucaccgacuggagcggguacagcggcuccuucgugcagcaccccgagcucaccggccuggacugcauccgccccugcuucuggguggagcugguccgggggcucccgaaggagaacacgaccaucuggaccagcggcuccagcaucuccuucugcggggugaacagcgacaccgccaacugguccuggcccgacggcgccgagcugcccuucacgaucgacaaguga

SEQ ID NO: 82228 - RNA, 1413 nt, Artificial Sequence
  derived and/or modified sequence opt1 from neuraminidase__InfluenzaA__AET84363
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccgcaucgggagcaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccguggccuggagcgccuccgcgugccacgacggcaugggcuggcucaccaucgggaucagcggccccgacaacggggccgucgccgugcugaaguacaacggcaucaucacgggcaccaucaaguccuggaagaagcagauccugcggacccaggagagcgagugcgugugcaugaacggguccugcuucaccaucaugacggacggccccagcaacaaggccgccuccuacaagaucuucaagaucgagaaggggaaggucaccaagagcaucgagcucaacgcgcccaacuucuacuacgaggagugcuccugcuacccggacaccggcaucgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugaccgucgacggcgccaacggggugaagggcuucagcuacaaguacggcaacgggguguggaucggccggacgaaguccaaccgccugcggaagggguucgagaugaucugggaccccaacggcuggaccaacaccgacagcgacuucuccgucaagcaggacgugguggccaucaccgacuggagcggguacagcggcuccuucguccagcaccccgagcucacgggccuggacugcauccgccccugcuucuggguggagcuggugcgggggcucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 82229 - RNA, 1413 nt, Artificial Sequence
  derived and/or modified sequence opt1 from neuraminidase__InfluenzaA__AET84374
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucaccgagacgaucaaguccuggaagaagcagauccugcggacccaggagagcgagugcgucugcaugaacggcuccugcuucaccaucaugaccgacgggcccagcaacaaggccgccuccuacaagaucuucaagaucgagaagggcaaggugaccaagagcaucgagcucaacgcgcccaacuucuacuacgaggagugcuccugcuacccggacacggggaucgugaugugcgucugccgcgacaacuggcacggcagcaaccggcccuggguguccuucaaccagaaccuggacuaccagaucggguacaucugcagcggcguguucggcgacaacccccgccccaaggacggggagggcuccugcaacccggucaccguggacggggccaacggcgugaagggguucagcuacaaguacggcaacggcgucuggaucgggcggaccaaguccaaccgccugcggaagggcuucgagaugaucugggaccccaacggguggacgaacaccgacagcgacuucuccgugaagcaggacguggucgccaucaccgacuggagcggcuacagcggguccuucgugcagcaccccgagcucaccggccuggacugcauccgccccugcuucuggguggagcugguccggggccucccgcgcgagaacacgaccaucuggaccagcggguccagcaucuccuucugcggcgugaacagcgacaccgccaacugguccuggcccgacggggccgagcugcccuucacgaucgacaaguga

SEQ ID NO: 82230 - RNA, 1413 nt, Artificial Sequence
  derived and/or modified sequence opt1 from neuraminidase__InfluenzaA__AET84396
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccgcaucgggagcaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccguggccuggagcgccuccgcgugccacgacggcaugggcuggcucaccaucgggaucagcggccccgacaacggggccgucgccgugcugaaguacaacggcaucaucacggagaccaucaaguccuggaagaagcagauccugcggacccaggagagcgagugcgugugcaugaacggcuccugcuucaccaucaugacggacgggcccagcaacaaggccgccuccuacaagaucuucaagaucgagaagggcaaggucaccaagagcaucgagcucaacgcgcccaacuucuacuacgaggagugcuccugcuacccggacaccgggaucgugaugugcgugugccgcgacaacuggcacggcagcaaccggcccugggucuccuucaaccagaaccuggacuaccagaucggguacaucugcagcggcguguucggcgacaacccccgccccaaggacggggagggcuccugcaacccggugaccgucgacggggccaacggcgugaagggguucagcuacaaguacggcaacggcguguggaucgggcggacgaaguccaaccgccugcggaagggcuucgagaugaucugggaccccaacggguggaccaacaccgacagcgacuucuccgucaagcaggacgugguggccaucaccgacuggagcggcuacagcggguccuucguccagcaccccgagcucacgggccuggacugcauccgccccugcuucuggguggagcuggugcggggccucccgcgcgagaacaccaccaucuggaccagcggguccagcaucuccuucugcggcgucaacagcgacacggccaacugguccuggcccgacggggccgagcugcccuucaccaucgacaaguga

SEQ ID NO: 82231 - RNA, 1413 nt, Artificial Sequence
  derived and/or modified sequence opt1 from neuraminidase__InfluenzaA__AET84407
augaaccccaaccagcgcaucaucaccaucggcagcaucuccaucgccaucgggaucaucagccugaugcuccagaucggcaacaucaucuccaucugggccagccacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacgcagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagagcgagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggagcaaccggcccuggguguccuucaaccagaaccuggacuaccagaucggcuacaucugcagcggcguguucggggacaacccccgccccgaggacggcgagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacagcgacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccagcggcuccagcaucuccuucugcggggugaacagcgacaccgccaacugguccuggcccgacggcgccgagcugcccuucacgaucgacaaguga

SEQ ID NO: 82232 - RNA, 1413 nt, Artificial Sequence
  derived and/or modified sequence opt1 from neuraminidase__InfluenzaA__AET84418
augaaccccaaccagcgcaucaucgccaucggcagcaucuccaucgccaucgggaucaucagccugaugcuccagaucggcaacaucaucuccaucugggcgagccacuccauccagaucgggagccagaacaacaccggcaucugcaaccagcggaucaucaccuacgagaacuccacgugggugaaccacaccuacgucaacaucaacaacaccaacgugguggccggggaggacaagaccagcgucacgcuggccggcaacuccagccugugcuccaucagcggcugggccaucuacaccaaggacaacuccauccgcaucgggagcaagggcgacguguucgugauccgggagccguucaucuccugcagccaccucgagugccgcaccuucuuccugacccagggggcccugcucaacgacaagcacuccaacggcacggcgaaggaccggagccccuaccgcgcccugauguccugcccccugggggaggcccccagcccguacaacagcaaguucgaguccgucgccuggagcgcguccgccugccacgacggcaugggcuggcucaccaucgggaucagcggccccgacaacggggccguggccgugcugaaguacaacggcaucaucaccgagaccaucaaguccuggaagaagcagauccugcggacgcaggagagcgagugcgucugcaugaacggcuccugcuucaccaucaugaccgacgggcccagcaacaaggccgcguccuacaagaucuucaagaucgagaagggcaaggugaccaagagcaucgagcucaacgcccccaacuucuacuacgaggagugcuccugcuacccggacacggggaucgugaugugcgucugccgcgacaacuggcacggcagcaaccggcccuggguguccuucaaccagaaccuggacuaccagaucggguacaucugcagcggcguguucggcgacaacccccgccccgaggacggggagggcuccugcaacccggucaccguggacggggccaacggcgugaagggguucagcuacaaguacggcaacggcgucuggaucgggcggaccaaguccaaccgccugcggaagggcuucgagaugaucugggaccccaacggguggaccaacacggacagcgacuucuccgugaagcaggacguggucgccaucaccgacuggagcggcuacagcggguccuucgugcagcaccccgagcucaccggccuggacugcauccgccccugcuucuggguggagcugguccggggccucccgcgcgagaacaccacgaucuggaccagcggguccagcaucuccuucugcggcgugaacagcgacaccgccaacugguccuggcccgacggggcggagcugcccuucaccaucgacaaguga

SEQ ID NO: 82233 - RNA, 1413 nt, Artificial Sequence
  derived and/or modified sequence opt1 from neuraminidase__InfluenzaA__AET84429
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccaggaccuggacuaccagaucggcuacaucugcuccggcgucuucggggacaacccccggcccaaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 82234 - RNA, 1413 nt, Artificial Sequence
  derived and/or modified sequence opt1 from neuraminidase__InfluenzaA__AET84440
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcagcaaccgccccuggguguccuucaaccagaaccuggacuaccagaucggguacaucugcagcggcgucuucggcgacaacccccggcccaaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 82235 - RNA, 1413 nt, Artificial Sequence
  derived and/or modified sequence opt1 from neuraminidase__InfluenzaA__AET84451
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugaccaagggcgcccugcucaacgacaagcacuccaacgggaccgucaccgaccgcagccccuaccgggcccugauguccugcccccugggcgaggcgcccagcccguacaacagccgcuucgaguccguggccuggagcgccuccgccugccacgacgggaugggcuggcucacgaucggcaucagcgggcccgacaacggcgcgguggccguccugaaguacaacgggaucaucaccgagaccaucaaguccuggaagaagcggauccugcgcacccaggagagcgagugcgugugcaugaacggcuccugcuucacgaucaugaccgacggccccagcaacggggccgccuccuacaagaucuucaagaucgagaagggcaaggugaccaagaccaucgagcucaacgcccccaacuuccacuacgaggagugcagcugcuacccggacacggggaccgucaugugcgugugccgggacaacuggcacggcuccaaccgccccugggugagcuucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacagcgggagcuucgugcagcaccccgagcucaccggccuggacugcauccggcccugcuucugggucgagcuggugcgcggccucccgcgggagaacacgaccaucuggaccuccgggagcuccaucagcuucugcggcgucaacuccgggaccgccaacuggagcuggcccgacggcgccgagcugcccuucacgaucgacaaguga

SEQ ID NO: 82236 - RNA, 1410 nt, Artificial Sequence; identical to SEQ ID NO: 77746
  derived and/or modified sequence opt1 from neuraminidase__InfluenzaA__AEV53421

SEQ ID NO: 82237 - RNA, 1410 nt, Artificial Sequence; identical to SEQ ID NO: 77746
  derived and/or modified sequence opt1 from neuraminidase__InfluenzaA__AEV53423

SEQ ID NO: 82238 - RNA, 1410 nt, Artificial Sequence; identical to SEQ ID NO: 79208
  derived and/or modified sequence opt1 from neuraminidase__InfluenzaA__AEV53425

SEQ ID NO: 82239 - RNA, 1410 nt, Artificial Sequence; identical to SEQ ID NO: 77746
  derived and/or modified sequence opt1 from neuraminidase__InfluenzaA__AEV53427

SEQ ID NO: 82240 - RNA, 1410 nt, Artificial Sequence; identical to SEQ ID NO: 79208
  derived and/or modified sequence opt1 from neuraminidase__InfluenzaA__AEV53429

SEQ ID NO: 82241 - RNA, 1410 nt, Artificial Sequence
  derived and/or modified sequence opt1 from neuraminidase__InfluenzaA__AEV53431
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgggaccgucggcuggagcuggccggacggcgccgagcugcccuucacgaucgacaaguga

SEQ ID NO: 82242 - RNA, 1410 nt, Artificial Sequence; identical to SEQ ID NO: 77746
  derived and/or modified sequence opt1 from neuraminidase__InfluenzaA__AEV53435

SEQ ID NO: 82243 - RNA, 1410 nt, Artificial Sequence
  derived and/or modified sequence opt1 from neuraminidase__InfluenzaA__AEV53437
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacacgcugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 82244 - RNA, 1410 nt, Artificial Sequence; identical to SEQ ID NO: 77746
  derived and/or modified sequence opt1 from neuraminidase__InfluenzaA__AEV53439

SEQ ID NO: 82245 - RNA, 1410 nt, Artificial Sequence; identical to SEQ ID NO: 77746
  derived and/or modified sequence opt1 from neuraminidase__InfluenzaA__AEV53441

SEQ ID NO: 82246 - RNA, 1410 nt, Artificial Sequence; identical to SEQ ID NO: 77746
  derived and/or modified sequence opt1 from neuraminidase__InfluenzaA__AEV53443

SEQ ID NO: 82247 - RNA, 1410 nt, Artificial Sequence
  derived and/or modified sequence opt1 from neuraminidase__InfluenzaA__AEV53445
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgaccacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82248 - RNA, 1410 nt, Artificial Sequence; identical to SEQ ID NO: 77746
  derived and/or modified sequence opt1 from neuraminidase__InfluenzaA__AEV53447

SEQ ID NO: 82249 - RNA, 1410 nt, Artificial Sequence; identical to SEQ ID NO: 79648
  derived and/or modified sequence opt1 from neuraminidase__InfluenzaA__AEV53449

SEQ ID NO: 82250 - RNA, 1410 nt, Artificial Sequence
  derived and/or modified sequence opt1 from neuraminidase__InfluenzaA__AEV53451
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccgacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 82251 - RNA, 1410 nt, Artificial Sequence; identical to SEQ ID NO: 77746
  derived and/or modified sequence opt1 from neuraminidase__InfluenzaA__AEV53453

SEQ ID NO: 82252 - RNA, 1410 nt, Artificial Sequence
  derived and/or modified sequence opt1 from neuraminidase__InfluenzaA__AEV53455
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucagcaucaagcaggacaucgugggcaucaacgagugguccggguacagcggcuccuucgugcagcacccggagcugacggggcugaacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82253 - RNA, 1410 nt, Artificial Sequence
  derived and/or modified sequence opt1 from neuraminidase__InfluenzaA__AEV53457
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcgucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82254 - RNA, 1410 nt, Artificial Sequence
  derived and/or modified sequence opt1 from neuraminidase__InfluenzaA__AEV53459
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaucaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucagcaucaagcaggacaucgugggcaucaacgagugguccggguacagcggcuccuucgugcagcacccggagcugacggggcugaacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82255 - RNA, 1410 nt, Artificial Sequence; identical to SEQ ID NO: 77746
  derived and/or modified sequence opt1 from neuraminidase__InfluenzaA__AEV53461

SEQ ID NO: 82256 - RNA, 1410 nt, Artificial Sequence
  derived and/or modified sequence opt1 from neuraminidase__InfluenzaA__AEV53463
augaaccccaaccagaagaucaucaccaucggcagcgugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcaucaacggcagcugcuucaccgugaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 82257 - RNA, 1410 nt, Artificial Sequence
  derived and/or modified sequence opt1 from neuraminidase__InfluenzaA__AEV53465
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgaccgccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuacaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 82258 - RNA, 1410 nt, Artificial Sequence; identical to SEQ ID NO: 79547
  derived and/or modified sequence opt1 from neuraminidase__InfluenzaA__AEV53467

SEQ ID NO: 82259 - RNA, 1410 nt, Artificial Sequence; identical to SEQ ID NO: 79547
  derived and/or modified sequence opt1 from neuraminidase__InfluenzaA__AEV53469

SEQ ID NO: 82260 - RNA, 1410 nt, Artificial Sequence; identical to SEQ ID NO: 77746
  derived and/or modified sequence opt1 from neuraminidase__InfluenzaA__AEV53471

SEQ ID NO: 82261 - RNA, 1410 nt, Artificial Sequence; identical to SEQ ID NO: 77746
  derived and/or modified sequence opt1 from neuraminidase__InfluenzaA__AEV53473

SEQ ID NO: 82262 - RNA, 1410 nt, Artificial Sequence; identical to SEQ ID NO: 77746
  derived and/or modified sequence opt1 from neuraminidase__InfluenzaA__AEV53475

SEQ ID NO: 82263 - RNA, 1410 nt, Artificial Sequence; identical to SEQ ID NO: 77746
  derived and/or modified sequence opt1 from neuraminidase__InfluenzaA__AEV53477

SEQ ID NO: 82264 - RNA, 1410 nt, Artificial Sequence; identical to SEQ ID NO: 77746
  derived and/or modified sequence opt1 from neuraminidase__InfluenzaA__AEV53479

SEQ ID NO: 82265 - RNA, 1410 nt, Artificial Sequence; identical to SEQ ID NO: 77746
  derived and/or modified sequence opt1 from neuraminidase__InfluenzaA__AEV53481

SEQ ID NO: 82266 - RNA, 1410 nt, Artificial Sequence; identical to SEQ ID NO: 77746
  derived and/or modified sequence opt1 from neuraminidase__InfluenzaA__AEV53483

SEQ ID NO: 82267 - RNA, 1410 nt, Artificial Sequence
  derived and/or modified sequence opt1 from neuraminidase__InfluenzaA__AEV53485
augaaccccaaccagaagaucaucaccaucggcagcgugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82268 - RNA, 1410 nt, Artificial Sequence; identical to SEQ ID NO: 79547
  derived and/or modified sequence opt1 from neuraminidase__InfluenzaA__AEV53487

SEQ ID NO: 82269 - RNA, 1410 nt, Artificial Sequence; identical to SEQ ID NO: 78764
  derived and/or modified sequence opt1 from neuraminidase__InfluenzaA__AEV53489

SEQ ID NO: 82270 - RNA, 1410 nt, Artificial Sequence
  derived and/or modified sequence opt1 from neuraminidase__InfluenzaA__AEV53491
augaaccccaaccagaagaucaucaccaucggccuggugugcaugaccaucgggauggccaaccucauccugcagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82271 - RNA, 1410 nt, Artificial Sequence; identical to SEQ ID NO: 77746
  derived and/or modified sequence opt1 from neuraminidase__InfluenzaA__AEV53493

SEQ ID NO: 82272 - RNA, 1410 nt, Artificial Sequence; identical to SEQ ID NO: 79208
  derived and/or modified sequence opt1 from neuraminidase__InfluenzaA__AEV53495

SEQ ID NO: 82273 - RNA, 1410 nt, Artificial Sequence
  derived and/or modified sequence opt1 from neuraminidase__InfluenzaA__AEV53497
augaaccccaaccagaagaucaucaccaucggcagcgugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaaccuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82274 - RNA, 1410 nt, Artificial Sequence; identical to SEQ ID NO: 78764
  derived and/or modified sequence opt1 from neuraminidase__InfluenzaA__AEV53499

SEQ ID NO: 82275 - RNA, 1410 nt, Artificial Sequence; identical to SEQ ID NO: 77746
  derived and/or modified sequence opt1 from neuraminidase__InfluenzaA__AEV53501

SEQ ID NO: 82276 - RNA, 1410 nt, Artificial Sequence; identical to SEQ ID NO: 77746
  derived and/or modified sequence opt1 from neuraminidase__InfluenzaA__AEV53503

SEQ ID NO: 82277 - RNA, 1410 nt, Artificial Sequence; identical to SEQ ID NO: 77746
  derived and/or modified sequence opt1 from neuraminidase__InfluenzaA__AEV53505

SEQ ID NO: 82278 - RNA, 1410 nt, Artificial Sequence; identical to SEQ ID NO: 77746
  derived and/or modified sequence opt1 from neuraminidase__InfluenzaA__AEV53507

SEQ ID NO: 82279 - RNA, 1410 nt, Artificial Sequence; identical to SEQ ID NO: 77746
  derived and/or modified sequence opt1 from neuraminidase__InfluenzaA__AEV53509

SEQ ID NO: 82280 - RNA, 1410 nt, Artificial Sequence; identical to SEQ ID NO: 79208
  derived and/or modified sequence opt1 from neuraminidase__InfluenzaA__AEV53511

SEQ ID NO: 82281 - RNA, 1410 nt, Artificial Sequence; identical to SEQ ID NO: 79208
  derived and/or modified sequence opt1 from neuraminidase__InfluenzaA__AEV53513

SEQ ID NO: 82282 - RNA, 1410 nt, Artificial Sequence; identical to SEQ ID NO: 79208
  derived and/or modified sequence opt1 from neuraminidase__InfluenzaA__AEV53515

SEQ ID NO: 82283 - RNA, 1410 nt, Artificial Sequence
  derived and/or modified sequence opt1 from neuraminidase__InfluenzaA__AEV53517
augaaccccaaccagcgcaucaucaccaucggcagcgugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccggaucggcuccaagggggacguguucgucauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggagcugcuucaccgucaugaccgacggcccguccgacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 82284 - RNA, 1410 nt, Artificial Sequence; identical to SEQ ID NO: 77746
  derived and/or modified sequence opt1 from neuraminidase__InfluenzaA__AEV53519

SEQ ID NO: 82285 - RNA, 1410 nt, Artificial Sequence; identical to SEQ ID NO: 79208
  derived and/or modified sequence opt1 from neuraminidase__InfluenzaA__AEV53521

SEQ ID NO: 82286 - RNA, 1410 nt, Artificial Sequence; identical to SEQ ID NO: 79034
  derived and/or modified sequence opt1 from neuraminidase__InfluenzaA__AEV53523

SEQ ID NO: 82287 - RNA, 1410 nt, Artificial Sequence; identical to SEQ ID NO: 78100
  derived and/or modified sequence opt1 from neuraminidase__InfluenzaA__AEV53525

SEQ ID NO: 82288 - RNA, 1410 nt, Artificial Sequence; identical to SEQ ID NO: 77746
  derived and/or modified sequence opt1 from neuraminidase__InfluenzaA__AEV53527

SEQ ID NO: 82289 - RNA, 1410 nt, Artificial Sequence
  derived and/or modified sequence opt1 from neuraminidase__InfluenzaA__AEV53529
augaaccccaaccagaagaucaucaccaucggcagcgugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaaggagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82290 - RNA, 1410 nt, Artificial Sequence; identical to SEQ ID NO: 79208
  derived and/or modified sequence opt1 from neuraminidase__InfluenzaA__AEV53531

SEQ ID NO: 82291 - RNA, 1410 nt, Artificial Sequence
  derived and/or modified sequence opt1 from neuraminidase__InfluenzaA__AEV53533
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82292 - RNA, 1410 nt, Artificial Sequence; identical to SEQ ID NO: 77746
  derived and/or modified sequence opt1 from neuraminidase__InfluenzaA__AEV53535

SEQ ID NO: 82293 - RNA, 1410 nt, Artificial Sequence; identical to SEQ ID NO: 82267
  derived and/or modified sequence opt1 from neuraminidase__InfluenzaA__AEV53537

SEQ ID NO: 82294 - RNA, 1410 nt, Artificial Sequence; identical to SEQ ID NO: 77746
  derived and/or modified sequence opt1 from neuraminidase__InfluenzaA__AEV53539

SEQ ID NO: 82295 - RNA, 1410 nt, Artificial Sequence; identical to SEQ ID NO: 81185
  derived and/or modified sequence opt1 from neuraminidase__InfluenzaA__AEV53541

SEQ ID NO: 82296 - RNA, 1410 nt, Artificial Sequence; identical to SEQ ID NO: 81185
  derived and/or modified sequence opt1 from neuraminidase__InfluenzaA__AEV53543

SEQ ID NO: 82297 - RNA, 1410 nt, Artificial Sequence; identical to SEQ ID NO: 79394
  derived and/or modified sequence opt1 from neuraminidase__InfluenzaA__AEV53545

SEQ ID NO: 82298 - RNA, 1410 nt, Artificial Sequence; identical to SEQ ID NO: 81185
  derived and/or modified sequence opt1 from neuraminidase__InfluenzaA__AEV53547

SEQ ID NO: 82299 - RNA, 1410 nt, Artificial Sequence; identical to SEQ ID NO: 81185
  derived and/or modified sequence opt1 from neuraminidase__InfluenzaA__AEV53549

SEQ ID NO: 82300 - RNA, 1410 nt, Artificial Sequence; identical to SEQ ID NO: 81185
  derived and/or modified sequence opt1 from neuraminidase__InfluenzaA__AEV53551

SEQ ID NO: 82301 - RNA, 1410 nt, Artificial Sequence; identical to SEQ ID NO: 81185
  derived and/or modified sequence opt1 from neuraminidase__InfluenzaA__AEV53553

SEQ ID NO: 82302 - RNA, 1410 nt, Artificial Sequence; identical to SEQ ID NO: 82267
  derived and/or modified sequence opt1 from neuraminidase__InfluenzaA__AEV53555

SEQ ID NO: 82303 - RNA, 1410 nt, Artificial Sequence; identical to SEQ ID NO: 78764
  derived and/or modified sequence opt1 from neuraminidase__InfluenzaA__AEV53557

SEQ ID NO: 82304 - RNA, 1410 nt, Artificial Sequence; identical to SEQ ID NO: 77746
  derived and/or modified sequence opt1 from neuraminidase__InfluenzaA__AEV53559

SEQ ID NO: 82305 - RNA, 1410 nt, Artificial Sequence; identical to SEQ ID NO: 77746
  derived and/or modified sequence opt1 from neuraminidase__InfluenzaA__AEV53561

SEQ ID NO: 82306 - RNA, 1410 nt, Artificial Sequence; identical to SEQ ID NO: 79338
  derived and/or modified sequence opt1 from neuraminidase__InfluenzaA__AEV53563

SEQ ID NO: 82307 - RNA, 1410 nt, Artificial Sequence
  derived and/or modified sequence opt1 from neuraminidase__InfluenzaA__AEV53565
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccgcugacgaucgacaaguga

SEQ ID NO: 82308 - RNA, 1410 nt, Artificial Sequence
  derived and/or modified sequence opt1 from neuraminidase__InfluenzaA__AEV53567
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggccuggaucggccgcaccaagagcaucagcucccggaacggcuucgagaugaucugggaccccaacggguggaccgagaccgacaacaacuucagcaucaagcaggacaucgucggcaucaacgagugguccggguacagcggcuccuucgugcagcacccggagcugacggggcugaacugcauccgccccugcuucuggguggagcucauccggggccgccccaaggagaacaccaucuggaccagcggcuccagcaucuccuucugcggggucaacagcgacaccgugggcugguccuggcccgacggggcggagcugccguucacgaucgacaaguga

SEQ ID NO: 82309 - RNA, 1410 nt, Artificial Sequence; identical to SEQ ID NO: 77746
  derived and/or modified sequence opt1 from neuraminidase__InfluenzaA__AEV53569

SEQ ID NO: 82310 - RNA, 1410 nt, Artificial Sequence; identical to SEQ ID NO: 81185
  derived and/or modified sequence opt1 from neuraminidase__InfluenzaA__AEV53571

SEQ ID NO: 82311 - RNA, 1410 nt, Artificial Sequence; identical to SEQ ID NO: 81185
  derived and/or modified sequence opt1 from neuraminidase__InfluenzaA__AEV53573

SEQ ID NO: 82312 - RNA, 1410 nt, Artificial Sequence; identical to SEQ ID NO: 79547
  derived and/or modified sequence opt1 from neuraminidase__InfluenzaA__AEV53575

SEQ ID NO: 82313 - RNA, 1410 nt, Artificial Sequence
  derived and/or modified sequence opt1 from neuraminidase__InfluenzaA__AEV53577
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcagccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82314 - RNA, 1410 nt, Artificial Sequence; identical to SEQ ID NO: 82252
  derived and/or modified sequence opt1 from neuraminidase__InfluenzaA__AEV53579

SEQ ID NO: 82315 - RNA, 1410 nt, Artificial Sequence; identical to SEQ ID NO: 79547
  derived and/or modified sequence opt1 from neuraminidase__InfluenzaA__AEV53581

SEQ ID NO: 82316 - RNA, 1410 nt, Artificial Sequence; identical to SEQ ID NO: 79208
  derived and/or modified sequence opt1 from neuraminidase__InfluenzaA__AEV53583

SEQ ID NO: 82317 - RNA, 1410 nt, Artificial Sequence; identical to SEQ ID NO: 79208
  derived and/or modified sequence opt1 from neuraminidase__InfluenzaA__AEV53585

SEQ ID NO: 82318 - RNA, 1410 nt, Artificial Sequence
  derived and/or modified sequence opt1 from neuraminidase__InfluenzaA__AEV76877
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcacgaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 82319 - RNA, 1410 nt, Artificial Sequence; identical to SEQ ID NO: 77746
  derived and/or modified sequence opt1 from neuraminidase__InfluenzaA__AEW10576

SEQ ID NO: 82320 - RNA, 1410 nt, Artificial Sequence; identical to SEQ ID NO: 77746
  derived and/or modified sequence opt1 from neuraminidase__InfluenzaA__AEW10586

SEQ ID NO: 82321 - RNA, 1410 nt, Artificial Sequence; identical to SEQ ID NO: 77746
  derived and/or modified sequence opt1 from neuraminidase__InfluenzaA__AEW10596

SEQ ID NO: 82322 - RNA, 1410 nt, Artificial Sequence; identical to SEQ ID NO: 77746
  derived and/or modified sequence opt1 from neuraminidase__InfluenzaA__AEW10606

SEQ ID NO: 82323 - RNA, 1410 nt, Artificial Sequence; identical to SEQ ID NO: 78633
  derived and/or modified sequence opt1 from neuraminidase__InfluenzaA__AEW10616

SEQ ID NO: 82324 - RNA, 1410 nt, Artificial Sequence
  derived and/or modified sequence opt1 from neuraminidase__InfluenzaA__AEW10626
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82325 - RNA, 1410 nt, Artificial Sequence; identical to SEQ ID NO: 77746
  derived and/or modified sequence opt1 from neuraminidase__InfluenzaA__AEW10636

SEQ ID NO: 82326 - RNA, 1410 nt, Artificial Sequence; identical to SEQ ID NO: 77736
  derived and/or modified sequence opt1 from neuraminidase__InfluenzaA__AEW10646

SEQ ID NO: 82327 - RNA, 1410 nt, Artificial Sequence; identical to SEQ ID NO: 77746
  derived and/or modified sequence opt1 from neuraminidase__InfluenzaA__AEW10656

SEQ ID NO: 82328 - RNA, 1410 nt, Artificial Sequence; identical to SEQ ID NO: 77746
  derived and/or modified sequence opt1 from neuraminidase__InfluenzaA__AEW10666

SEQ ID NO: 82329 - RNA, 1410 nt, Artificial Sequence; identical to SEQ ID NO: 77746
  derived and/or modified sequence opt1 from neuraminidase__InfluenzaA__AEW10676

SEQ ID NO: 82330 - RNA, 1410 nt, Artificial Sequence; identical to SEQ ID NO: 77746
  derived and/or modified sequence opt1 from neuraminidase__InfluenzaA__AEW10686

SEQ ID NO: 82331 - RNA, 1410 nt, Artificial Sequence; identical to SEQ ID NO: 77746
  derived and/or modified sequence opt1 from neuraminidase__InfluenzaA__AEW10696

SEQ ID NO: 82332 - RNA, 1410 nt, Artificial Sequence; identical to SEQ ID NO: 77746
  derived and/or modified sequence opt1 from neuraminidase__InfluenzaA__AEW10706

SEQ ID NO: 82333 - RNA, 1410 nt, Artificial Sequence; identical to SEQ ID NO: 77736
  derived and/or modified sequence opt1 from neuraminidase__InfluenzaA__AEW10716

SEQ ID NO: 82334 - RNA, 1410 nt, Artificial Sequence; identical to SEQ ID NO: 77746
  derived and/or modified sequence opt1 from neuraminidase__InfluenzaA__AEW10726

SEQ ID NO: 82335 - RNA, 1410 nt, Artificial Sequence; identical to SEQ ID NO: 77746
  derived and/or modified sequence opt1 from neuraminidase__InfluenzaA__AEW10736

SEQ ID NO: 82336 - RNA, 1410 nt, Artificial Sequence; identical to SEQ ID NO: 77736
  derived and/or modified sequence opt1 from neuraminidase__InfluenzaA__AEW10746

SEQ ID NO: 82337 - RNA, 1410 nt, Artificial Sequence; identical to SEQ ID NO: 77736
  derived and/or modified sequence opt1 from neuraminidase__InfluenzaA__AEW10756

SEQ ID NO: 82338 - RNA, 1410 nt, Artificial Sequence; identical to SEQ ID NO: 77736
  derived and/or modified sequence opt1 from neuraminidase__InfluenzaA__AEW10766

SEQ ID NO: 82339 - RNA, 1410 nt, Artificial Sequence; identical to SEQ ID NO: 77736
  derived and/or modified sequence opt1 from neuraminidase__InfluenzaA__AEW10776

SEQ ID NO: 82340 - RNA, 1410 nt, Artificial Sequence; identical to SEQ ID NO: 77736
  derived and/or modified sequence opt1 from neuraminidase__InfluenzaA__AEW10786

SEQ ID NO: 82341 - RNA, 1410 nt, Artificial Sequence; identical to SEQ ID NO: 77736
  derived and/or modified sequence opt1 from neuraminidase__InfluenzaA__AEW10796

SEQ ID NO: 82342 - RNA, 1410 nt, Artificial Sequence; identical to SEQ ID NO: 77736
  derived and/or modified sequence opt1 from neuraminidase__InfluenzaA__AEW10806

SEQ ID NO: 82343 - RNA, 1410 nt, Artificial Sequence; identical to SEQ ID NO: 77736
  derived and/or modified sequence opt1 from neuraminidase__InfluenzaA__AEW10816

SEQ ID NO: 82344 - RNA, 1410 nt, Artificial Sequence; identical to SEQ ID NO: 77746
  derived and/or modified sequence opt1 from neuraminidase__InfluenzaA__AEW10826

SEQ ID NO: 82345 - RNA, 1410 nt, Artificial Sequence; identical to SEQ ID NO: 77736
  derived and/or modified sequence opt1 from neuraminidase__InfluenzaA__AEW10836

SEQ ID NO: 82346 - RNA, 1410 nt, Artificial Sequence; identical to SEQ ID NO: 77736
  derived and/or modified sequence opt1 from neuraminidase__InfluenzaA__AEW10846

SEQ ID NO: 82347 - RNA, 1410 nt, Artificial Sequence; identical to SEQ ID NO: 77736
  derived and/or modified sequence opt1 from neuraminidase__InfluenzaA__AEW10856

SEQ ID NO: 82348 - RNA, 1410 nt, Artificial Sequence; identical to SEQ ID NO: 77736
  derived and/or modified sequence opt1 from neuraminidase__InfluenzaA__AEW10866

SEQ ID NO: 82349 - RNA, 1410 nt, Artificial Sequence; identical to SEQ ID NO: 77736
  derived and/or modified sequence opt1 from neuraminidase__InfluenzaA__AEW10876

SEQ ID NO: 82350 - RNA, 1410 nt, Artificial Sequence; identical to SEQ ID NO: 77736
  derived and/or modified sequence opt1 from neuraminidase__InfluenzaA__AEW10886

SEQ ID NO: 82351 - RNA, 1410 nt, Artificial Sequence; identical to SEQ ID NO: 77736
  derived and/or modified sequence opt1 from neuraminidase__InfluenzaA__AEW10896

SEQ ID NO: 82352 - RNA, 1410 nt, Artificial Sequence; identical to SEQ ID NO: 77736
  derived and/or modified sequence opt1 from neuraminidase__InfluenzaA__AEW10906

SEQ ID NO: 82353 - RNA, 1410 nt, Artificial Sequence; identical to SEQ ID NO: 77736
  derived and/or modified sequence opt1 from neuraminidase__InfluenzaA__AEW10916

SEQ ID NO: 82354 - RNA, 1410 nt, Artificial Sequence
  derived and/or modified sequence opt1 from neuraminidase__InfluenzaA__AEW10926
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82355 - RNA, 1410 nt, Artificial Sequence; identical to SEQ ID NO: 77736
  derived and/or modified sequence opt1 from neuraminidase__InfluenzaA__AEW10936

SEQ ID NO: 82356 - RNA, 1410 nt, Artificial Sequence; identical to SEQ ID NO: 77736
  derived and/or modified sequence opt1 from neuraminidase__InfluenzaA__AEW10946

SEQ ID NO: 82357 - RNA, 1410 nt, Artificial Sequence; identical to SEQ ID NO: 77746
  derived and/or modified sequence opt1 from neuraminidase__InfluenzaA__AEW10956

SEQ ID NO: 82358 - RNA, 1410 nt, Artificial Sequence; identical to SEQ ID NO: 77746
  derived and/or modified sequence opt1 from neuraminidase__InfluenzaA__AEW10966

SEQ ID NO: 82359 - RNA, 1410 nt, Artificial Sequence; identical to SEQ ID NO: 77736
  derived and/or modified sequence opt1 from neuraminidase__InfluenzaA__AEW10976

SEQ ID NO: 82360 - RNA, 1410 nt, Artificial Sequence; identical to SEQ ID NO: 77746
  derived and/or modified sequence opt1 from neuraminidase__InfluenzaA__AEW10986

SEQ ID NO: 82361 - RNA, 1410 nt, Artificial Sequence; identical to SEQ ID NO: 77746
  derived and/or modified sequence opt1 from neuraminidase__InfluenzaA__AEW10996

SEQ ID NO: 82362 - RNA, 1410 nt, Artificial Sequence; identical to SEQ ID NO: 77746
  derived and/or modified sequence opt1 from neuraminidase__InfluenzaA__AEW11006

SEQ ID NO: 82363 - RNA, 1410 nt, Artificial Sequence; identical to SEQ ID NO: 77746
  derived and/or modified sequence opt1 from neuraminidase__InfluenzaA__AEW11016

SEQ ID NO: 82364 - RNA, 1410 nt, Artificial Sequence; identical to SEQ ID NO: 77746
  derived and/or modified sequence opt1 from neuraminidase__InfluenzaA__AEW11026

SEQ ID NO: 82365 - RNA, 1410 nt, Artificial Sequence; identical to SEQ ID NO: 77746
  derived and/or modified sequence opt1 from neuraminidase__InfluenzaA__AEW11036

SEQ ID NO: 82366 - RNA, 1410 nt, Artificial Sequence; identical to SEQ ID NO: 77736
  derived and/or modified sequence opt1 from neuraminidase__InfluenzaA__AEW11046

SEQ ID NO: 82367 - RNA, 1410 nt, Artificial Sequence; identical to SEQ ID NO: 77746
  derived and/or modified sequence opt1 from neuraminidase__InfluenzaA__AEW11056

SEQ ID NO: 82368 - RNA, 1410 nt, Artificial Sequence; identical to SEQ ID NO: 78550
  derived and/or modified sequence opt1 from neuraminidase__InfluenzaA__AEW11066

SEQ ID NO: 82369 - RNA, 1410 nt, Artificial Sequence; identical to SEQ ID NO: 78550
  derived and/or modified sequence opt1 from neuraminidase__InfluenzaA__AEW11076

SEQ ID NO: 82370 - RNA, 1410 nt, Artificial Sequence; identical to SEQ ID NO: 78550
  derived and/or modified sequence opt1 from neuraminidase__InfluenzaA__AEW11086

SEQ ID NO: 82371 - RNA, 1410 nt, Artificial Sequence; identical to SEQ ID NO: 78550
  derived and/or modified sequence opt1 from neuraminidase__InfluenzaA__AEW11096

SEQ ID NO: 82372 - RNA, 1410 nt, Artificial Sequence; identical to SEQ ID NO: 78550
  derived and/or modified sequence opt1 from neuraminidase__InfluenzaA__AEW11106

SEQ ID NO: 82373 - RNA, 1410 nt, Artificial Sequence; identical to SEQ ID NO: 77746
  derived and/or modified sequence opt1 from neuraminidase__InfluenzaA__AEW11116

SEQ ID NO: 82374 - RNA, 1410 nt, Artificial Sequence; identical to SEQ ID NO: 78550
  derived and/or modified sequence opt1 from neuraminidase__InfluenzaA__AEW11126

SEQ ID NO: 82375 - RNA, 1410 nt, Artificial Sequence; identical to SEQ ID NO: 78454
  derived and/or modified sequence opt1 from neuraminidase__InfluenzaA__AEW11136

SEQ ID NO: 82376 - RNA, 1410 nt, Artificial Sequence; identical to SEQ ID NO: 77746
  derived and/or modified sequence opt1 from neuraminidase__InfluenzaA__AEW11146

SEQ ID NO: 82377 - RNA, 1410 nt, Artificial Sequence; identical to SEQ ID NO: 77746
  derived and/or modified sequence opt1 from neuraminidase__InfluenzaA__AEW11156

SEQ ID NO: 82378 - RNA, 1410 nt, Artificial Sequence; identical to SEQ ID NO: 78550
  derived and/or modified sequence opt1 from neuraminidase__InfluenzaA__AEW11166

SEQ ID NO: 82379 - RNA, 1410 nt, Artificial Sequence; identical to SEQ ID NO: 78550
  derived and/or modified sequence opt1 from neuraminidase__InfluenzaA__AEW11176

SEQ ID NO: 82380 - RNA, 1410 nt, Artificial Sequence; identical to SEQ ID NO: 77746
  derived and/or modified sequence opt1 from neuraminidase__InfluenzaA__AEW11186

SEQ ID NO: 82381 - RNA, 1410 nt, Artificial Sequence; identical to SEQ ID NO: 78550
  derived and/or modified sequence opt1 from neuraminidase__InfluenzaA__AEW11196

SEQ ID NO: 82382 - RNA, 1410 nt, Artificial Sequence; identical to SEQ ID NO: 77746
  derived and/or modified sequence opt1 from neuraminidase__InfluenzaA__AEW11206

SEQ ID NO: 82383 - RNA, 1410 nt, Artificial Sequence; identical to SEQ ID NO: 77746
  derived and/or modified sequence opt1 from neuraminidase__InfluenzaA__AEW11216

SEQ ID NO: 82384 - RNA, 1410 nt, Artificial Sequence; identical to SEQ ID NO: 78454
  derived and/or modified sequence opt1 from neuraminidase__InfluenzaA__AEW11226

SEQ ID NO: 82385 - RNA, 1410 nt, Artificial Sequence; identical to SEQ ID NO: 77746
  derived and/or modified sequence opt1 from neuraminidase__InfluenzaA__AEW11236

SEQ ID NO: 82386 - RNA, 1410 nt, Artificial Sequence; identical to SEQ ID NO: 77746
  derived and/or modified sequence opt1 from neuraminidase__InfluenzaA__AEW11246

SEQ ID NO: 82387 - RNA, 1410 nt, Artificial Sequence; identical to SEQ ID NO: 78550
  derived and/or modified sequence opt1 from neuraminidase__InfluenzaA__AEW11255

SEQ ID NO: 82388 - RNA, 1410 nt, Artificial Sequence; identical to SEQ ID NO: 78550
  derived and/or modified sequence opt1 from neuraminidase__InfluenzaA__AEW11265

SEQ ID NO: 82389 - RNA, 1410 nt, Artificial Sequence; identical to SEQ ID NO: 77746
  derived and/or modified sequence opt1 from neuraminidase__InfluenzaA__AEW11275

SEQ ID NO: 82390 - RNA, 1410 nt, Artificial Sequence
  derived and/or modified sequence opt1 from neuraminidase__InfluenzaA__AEW11285
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagaacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82391 - RNA, 1410 nt, Artificial Sequence; identical to SEQ ID NO: 78550
  derived and/or modified sequence opt1 from neuraminidase__InfluenzaA__AEW11295

SEQ ID NO: 82392 - RNA, 1410 nt, Artificial Sequence; identical to SEQ ID NO: 77746
  derived and/or modified sequence opt1 from neuraminidase__InfluenzaA__AEW11305

SEQ ID NO: 82393 - RNA, 1410 nt, Artificial Sequence; identical to SEQ ID NO: 78550
  derived and/or modified sequence opt1 from neuraminidase__InfluenzaA__AEW11315

SEQ ID NO: 82394 - RNA, 1410 nt, Artificial Sequence; identical to SEQ ID NO: 77746
  derived and/or modified sequence opt1 from neuraminidase__InfluenzaA__AEW11325

SEQ ID NO: 82395 - RNA, 1410 nt, Artificial Sequence; identical to SEQ ID NO: 77746
  derived and/or modified sequence opt1 from neuraminidase__InfluenzaA__AEW25299

SEQ ID NO: 82396 - RNA, 1410 nt, Artificial Sequence; identical to SEQ ID NO: 77746
  derived and/or modified sequence opt1 from neuraminidase__InfluenzaA__AEW25308

SEQ ID NO: 82397 - RNA, 1410 nt, Artificial Sequence; identical to SEQ ID NO: 78819
  derived and/or modified sequence opt1 from neuraminidase__InfluenzaA__AEW25317

SEQ ID NO: 82398 - RNA, 1410 nt, Artificial Sequence; identical to SEQ ID NO: 77746
  derived and/or modified sequence opt1 from neuraminidase__InfluenzaA__AEW25324

SEQ ID NO: 82399 - RNA, 1410 nt, Artificial Sequence
  derived and/or modified sequence opt1 from neuraminidase__InfluenzaA__AEW25327
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggucccgccgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacugcgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 82400 - RNA, 1410 nt, Artificial Sequence
  derived and/or modified sequence opt1 from neuraminidase__InfluenzaA__AEW25333
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucugggugggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccacugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 82401 - RNA, 1410 nt, Artificial Sequence
  derived and/or modified sequence opt1 from neuraminidase__InfluenzaA__AEW25338
augaaccccaaccagaagaucaucaccaucggcagcgugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacauccgguccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgcggagcugccguucaccaucgacaaguga

SEQ ID NO: 82402 - RNA, 1410 nt, Artificial Sequence
  derived and/or modified sequence opt1 from neuraminidase__InfluenzaA__AEW25343
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccggagcgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgugugcgcgugcgugaacggguccugcuucaccgucaugaccgacggcccgagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcagcggcaucuucggggacuccccgcggcccaacgacaagaccggcagcugcggccccguguccagcaacggggccaacggcgucaagggguucagcuucaaguacggcaacgggguguggaucggccgcaccaaguccaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82403 - RNA, 1410 nt, Artificial Sequence
  derived and/or modified sequence opt1 from neuraminidase__InfluenzaA__AEW25351
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaacgaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaccuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 82404 - RNA, 1410 nt, Artificial Sequence
  derived and/or modified sequence opt1 from neuraminidase__InfluenzaA__AEW25358
augaaccccaaccagaagaucaucaccaucggcagcgugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaccagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgugaaguga

SEQ ID NO: 82405 - RNA, 1410 nt, Artificial Sequence; identical to SEQ ID NO: 77746
  derived and/or modified sequence opt1 from neuraminidase__InfluenzaA__AEW25361

SEQ ID NO: 82406 - RNA, 1410 nt, Artificial Sequence
  derived and/or modified sequence opt1 from neuraminidase__InfluenzaA__AEW25379
augaaccccaaccagaagaucaucaccaucggcagcgugugcaugaccaucgggauggccaaccugauccuccagaucggcaacaucaucuccaucuggacgagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgaggugacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcgacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 82407 - RNA, 1410 nt, Artificial Sequence
  derived and/or modified sequence opt1 from neuraminidase__InfluenzaA__AEW25387
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcguggacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucgaggacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82408 - RNA, 1410 nt, Artificial Sequence
  derived and/or modified sequence opt1 from neuraminidase__InfluenzaA__AEW25392
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcacgacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82409 - RNA, 1410 nt, Artificial Sequence
  derived and/or modified sequence opt1 from neuraminidase__InfluenzaA__AEW25397
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagcccguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgcccgugggucuccuucaaccagaaccucgaguaccagaucggguacaucugcagcggcaucuucggggacagcccccggcccaacgacaagaccggcuccugcggccccguguccagcaacggggccaacggcgugaagggguucuccuucaaguacggcaacggggucuggaucggccgcaccaagagcaucagcucccggaacggcuucgagaugaucugggacccgaacggguggaccggcaccgacaacaacuucagcaucaagcaggacaucguggggaucaacgagugguccggcuacagcggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaacgucgggugguccuggccggacggcgccgagcugcccuucaccaucgacaaguga

SEQ ID NO: 82410 - RNA, 1410 nt, Artificial Sequence; identical to SEQ ID NO: 77746
  derived and/or modified sequence opt1 from neuraminidase__InfluenzaA__AEW25402

SEQ ID NO: 82411 - RNA, 1410 nt, Artificial Sequence; identical to SEQ ID NO: 77746
  derived and/or modified sequence opt1 from neuraminidase__InfluenzaA__AEW25407

SEQ ID NO: 82412 - RNA, 1410 nt, Artificial Sequence
  derived and/or modified sequence opt1 from neuraminidase__InfluenzaA__AEW25418
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgggaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccagcaacggcgagaacggggugaagggcuucuccuucaaguacgggaacggcgucuggaucggccgcaccaagagcaucagcucccggaacggguucgagaugaucugggaccccaacggcuggaccgggaccgacaacaacuucagcaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguucuggcccgacggcgccgagcugccguucacgaucgacaaguga

SEQ ID NO: 82413 - RNA, 1410 nt, Artificial Sequence
  derived and/or modified sequence opt1 from neuraminidase__InfluenzaA__AEW25423
augaaccccaaccagaagaucaucaccaucggcagcgugugcaugaccaucgggauggccaaccugauccuccagaucggcaacaucaucuccaucuggaucagcaacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82414 - RNA, 1410 nt, Artificial Sequence; identical to SEQ ID NO: 77746
  derived and/or modified sequence opt1 from neuraminidase__InfluenzaA__AEW25426

SEQ ID NO: 82415 - RNA, 1410 nt, Artificial Sequence
  derived and/or modified sequence opt1 from neuraminidase__InfluenzaA__AEW25432
augaaccccaaccagaagaucaucaccaucggcagcgugugcaugaccaucgggauggccaaccugauccuccagaucggcaacaucaucuccaucuggacgagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacagcuccaucaagcaggacaucguggggaucaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcaucaacuccgacgccgugggguggagcuggcccgacggcgcggagcugccguucacgaucgacaaguga

SEQ ID NO: 82416 - RNA, 1410 nt, Artificial Sequence
  derived and/or modified sequence opt1 from neuraminidase__InfluenzaA__AEW25436
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccggaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggacgaacgagugguccggcuacagcggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgauggggugguccuggcccgacggcgccgagcugccguucaccaucgacaaguga

SEQ ID NO: 82417 - RNA, 1410 nt, Artificial Sequence; identical to SEQ ID NO: 77746
  derived and/or modified sequence opt1 from neuraminidase__InfluenzaA__AEW25440

SEQ ID NO: 82418 - RNA, 1410 nt, Artificial Sequence
  derived and/or modified sequence opt1 from neuraminidase__InfluenzaA__AEW25448
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaccgacaaguga

SEQ ID NO: 82419 - RNA, 1410 nt, Artificial Sequence; identical to SEQ ID NO: 77746
  derived and/or modified sequence opt1 from neuraminidase__InfluenzaA__AEW25456

SEQ ID NO: 82420 - RNA, 1410 nt, Artificial Sequence
  derived and/or modified sequence opt1 from neuraminidase__InfluenzaA__AEW25464
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagcucaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82421 - RNA, 1410 nt, Artificial Sequence
  derived and/or modified sequence opt1 from neuraminidase__InfluenzaA__AEW25474
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccgagcacgaucgacaaguga

SEQ ID NO: 82422 - RNA, 1410 nt, Artificial Sequence
  derived and/or modified sequence opt1 from neuraminidase__InfluenzaA__AEW25484
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccuggaucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcucccaccuggagugccgcaccuucuuccugacccagggcgcccuccugaacgacaagcacagcaacgggaccaucaaggaccggucccccuaccgcacgcugaugagcugccccaucggcgaggugccgucccccuacaacagccgguucgagagcgucgccugguccgcgagcgccugccacgacgggaucaacuggcucaccaucggcaucuccggccccgaccacggggccguggccgugcugaaguacaacggcaucaucaccgacaccaucaagagcuggcgcaacaacauccugcggacgcaggaguccgagugcgcgugcgucaacgggagcugcuucaccgugaugaccgacggccccuccgacggccaggccagcuacaagaucuuccgcaucgagaaggggaagaucgugaaguccgucgagaugaacgccccgaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccccggccgaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 82423 - RNA, 1410 nt, Artificial Sequence
  derived and/or modified sequence opt1 from neuraminidase__InfluenzaA__AEW25494
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacagcaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaccuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82424 - RNA, 1410 nt, Artificial Sequence
  derived and/or modified sequence opt1 from neuraminidase__InfluenzaA__AEW25503
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggccuggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 82425 - RNA, 1410 nt, Artificial Sequence
  derived and/or modified sequence opt1 from neuraminidase__InfluenzaA__AEW25511
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggugguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82426 - RNA, 1410 nt, Artificial Sequence
  derived and/or modified sequence opt1 from neuraminidase__InfluenzaA__AEW25530
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcuacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggagaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82427 - RNA, 1410 nt, Artificial Sequence
  derived and/or modified sequence opt1 from neuraminidase__InfluenzaA__AEW25537
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaaccaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82428 - RNA, 1410 nt, Artificial Sequence; identical to SEQ ID NO: 77746
  derived and/or modified sequence opt1 from neuraminidase__InfluenzaA__AEW25547

SEQ ID NO: 82429 - RNA, 1410 nt, Artificial Sequence; identical to SEQ ID NO: 77746
  derived and/or modified sequence opt1 from neuraminidase__InfluenzaA__AEW25556

SEQ ID NO: 82430 - RNA, 1410 nt, Artificial Sequence; identical to SEQ ID NO: 77746
  derived and/or modified sequence opt1 from neuraminidase__InfluenzaA__AEW25566

SEQ ID NO: 82431 - RNA, 1410 nt, Artificial Sequence
  derived and/or modified sequence opt1 from neuraminidase__InfluenzaA__AEW25584
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggggaucgugggcaucaacgagugguccggguacggcggcagcuucgugcagcacccggagcugacggggcuggacugcauccgccccugcuucugggucgagcucauccggggccgccccaaggagaacaccaucuggaccuccgggagcuccaucagcuucugcggcgugaacuccgacaccgucggcuggagcuggcccgacggggccgagcugccguucacgaucgacaaguga

SEQ ID NO: 82432 - RNA, 1410 nt, Artificial Sequence; identical to SEQ ID NO: 77746
  derived and/or modified sequence opt1 from neuraminidase__InfluenzaA__AEW25592

SEQ ID NO: 82433 - RNA, 1410 nt, Artificial Sequence
  derived and/or modified sequence opt1 from neuraminidase__InfluenzaA__AEW25602
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaagaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82434 - RNA, 1410 nt, Artificial Sequence
  derived and/or modified sequence opt1 from neuraminidase__InfluenzaA__AEW25612
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgaccgccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 82435 - RNA, 1410 nt, Artificial Sequence
  derived and/or modified sequence opt1 from neuraminidase__InfluenzaA__AEW25622
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacagcaucuggaccuccgggagcuccaucagcuucugcggcgugaacuccgacaccgucggguggagcuggcccgacggcgccgagcugccguucaccaucgacaaguga

SEQ ID NO: 82436 - RNA, 1410 nt, Artificial Sequence
  derived and/or modified sequence opt1 from neuraminidase__InfluenzaA__AEW25631
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccuccggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82437 - RNA, 1410 nt, Artificial Sequence; identical to SEQ ID NO: 77746
  derived and/or modified sequence opt1 from neuraminidase__InfluenzaA__AEW25639

SEQ ID NO: 82438 - RNA, 1410 nt, Artificial Sequence
  derived and/or modified sequence opt1 from neuraminidase__InfluenzaA__AEW25648
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccacaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82439 - RNA, 1410 nt, Artificial Sequence
  derived and/or modified sequence opt1 from neuraminidase__InfluenzaA__AEW25656
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucccgaucaagcaggacaucguggggaucaacgaguggagcggcuacuccgggagcuucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 82440 - RNA, 1410 nt, Artificial Sequence
  derived and/or modified sequence opt1 from neuraminidase__InfluenzaA__AEW25664
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucaccgccggccagagcgucguguccgugaagcuggcggggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacaccgggggcugguccuggcccgacggcgccgagcugccguucacgaucgacaaguga

SEQ ID NO: 82441 - RNA, 1410 nt, Artificial Sequence; identical to SEQ ID NO: 82435
  derived and/or modified sequence opt1 from neuraminidase__InfluenzaA__AEW25671

SEQ ID NO: 82442 - RNA, 1410 nt, Artificial Sequence; identical to SEQ ID NO: 78923
  derived and/or modified sequence opt1 from neuraminidase__InfluenzaA__AEW25680

SEQ ID NO: 82443 - RNA, 1410 nt, Artificial Sequence
  derived and/or modified sequence opt1 from neuraminidase__InfluenzaA__AEW25689
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcgugggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82444 - RNA, 1410 nt, Artificial Sequence; identical to SEQ ID NO: 82438
  derived and/or modified sequence opt1 from neuraminidase__InfluenzaA__AEW25698

SEQ ID NO: 82445 - RNA, 1410 nt, Artificial Sequence; identical to SEQ ID NO: 77746
  derived and/or modified sequence opt1 from neuraminidase__InfluenzaA__AEW25708

SEQ ID NO: 82446 - RNA, 1410 nt, Artificial Sequence; identical to SEQ ID NO: 77746
  derived and/or modified sequence opt1 from neuraminidase__InfluenzaA__AEX09177

SEQ ID NO: 82447 - RNA, 1413 nt, Artificial Sequence
  derived and/or modified sequence opt1 from neuraminidase__InfluenzaA__AEX33324
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucacgaucaacaacaccaacgugguggcggggaaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccagcaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugaccgucgacggcgcggacggggugaagggcuucagcuacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggagcggguacagcggcuccuucguccagcaccccgagcucaccggccuggacugcauccgccccugcuucuggguggagcugguccgggggcucccgcgcgagaacaccacgaucuggaccagcggcuccagcaucuccuucugcggggugaacagcgacaccgccaacugguccuggcccgacggcgccgagcugcccuucaccaucgacaaguga

SEQ ID NO: 82448 - RNA, 1413 nt, Artificial Sequence
  derived and/or modified sequence opt1 from neuraminidase__InfluenzaA__AEX33368
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcgccaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcgcugaugagcugcccccugggggaggcccccuccccguacaacagcaaguucgagagcguggccugguccgccagcgcgugccacgacggcaugggcuggcucaccaucgggaucuccggccccgacaacggggccguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcgcccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggucgacggcgccgacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacugguccggguacagcggcagcuucguccagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 82449 - RNA, 1413 nt, Artificial Sequence
  derived and/or modified sequence opt1 from neuraminidase__InfluenzaA__AEX33379
augaaccccaaccagaagaucaucaccaucggcagcaucuccaucgccaucgggaucaucagccugaugcuccagaucggcaacaucaucuccaucugggccagccacuccauccagaccgggauccagaaccacacgggcaucugcaaccagcgcaucaucaccuacgagaacagcaccugggugaaccacaccuacgucacgaucaacaacaccaacgugguggcggggaaggacaagaccuccgucacccuggccggcaacagcucccugugcagcaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucagcuucaaccagaaccuggacuaccagaucggcuacaucugcuccggcguguucggggacaacccccgcccccgggacggcgaggggagcugcaacccggugaccgucgacggcgcggacggggugaagggcuucuccuacaaguacggcaacgggguguggaucggccgcaccaagagcaaccggcugcgcaagggguucgagaugaucugggaccccaacggcuggaccgacacggacuccgacuucagcgucaagcaggacgugguggccaucaccgacugguccggguacagcggcagcuucguccagcaccccgagcucaccggccuggacugcauccggcccugcuucuggguggagcugguccgcgggcucccgcgggagaacaccacgaucuggaccuccggcagcuccaucagcuucugcggggugaacuccgacaccgccaacuggagcuggcccgacggcgccgagcugcccuucaccaucgacaaguga

SEQ ID NO: 82450 - RNA, 1413 nt, Artificial Sequence; identical to SEQ ID NO: 82449
  derived and/or modified sequence opt1 from neuraminidase__InfluenzaA__AEX33390

SEQ ID NO: 82451 - RNA, 1413 nt, Artificial Sequence; identical to SEQ ID NO: 82449
  derived and/or modified sequence opt1 from neuraminidase__InfluenzaA__AEX33401

SEQ ID NO: 82452 - RNA, 1413 nt, Artificial Sequence; identical to SEQ ID NO: 82449
  derived and/or modified sequence opt1 from neuraminidase__InfluenzaA__AEX33412

SEQ ID NO: 82453 - RNA, 1413 nt, Artificial Sequence; identical to SEQ ID NO: 82449
  derived and/or modified sequence opt1 from neuraminidase__InfluenzaA__AEX33423

SEQ ID NO: 82454 - RNA, 1413 nt, Artificial Sequence; identical to SEQ ID NO: 82449
  derived and/or modified sequence opt1 from neuraminidase__InfluenzaA__AEX33434

SEQ ID NO: 82455 - RNA, 1413 nt, Artificial Sequence; identical to SEQ ID NO: 82449
  derived and/or modified sequence opt1 from neuraminidase__InfluenzaA__AEX33445

SEQ ID NO: 82456 - RNA, 1410 nt, Artificial Sequence
  derived and/or modified sequence opt1 from neuraminidase__InfluenzaA__AEX33544
augaaccccaaccagaagaucaucaccaucggcagcuucucccugaccaucgccgccaucugcuuccucaugcagaucgcgauccuggugacgaccgucacccugcacuucaagcagcacgagugcaacagcccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccagcuccagcugccacgacggcaaggccuggcugcacgugugcgucacgggggacgacaagaacgccaccgccuccuucaucuacaacggccggcugguggacagcaucggguccuggagcaagaagauccuccgcacccaggaguccgagugcgugugcaucaacgggaccugcacggucgugaugaccgacggcagcgcguccgggaaggccgacaccaagauccuguucaucgaggagggcaagaucgugcacaucagcacccugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggagaagaccgaggugugguggacgagcaacagcaucguggucuucugcggcaccuccgggaccuacggcaccgggagcuggccggacggcgccgacaucaaccugaugcccaucuga

SEQ ID NO: 82457 - RNA, 1410 nt, Artificial Sequence; identical to SEQ ID NO: 75722
  derived and/or modified sequence opt1 from neuraminidase__InfluenzaA__AEX33555

SEQ ID NO: 82458 - RNA, 1410 nt, Artificial Sequence
  derived and/or modified sequence opt1 from neuraminidase__InfluenzaA__AEX33610
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaccguccacgaccgcacccccuaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaagaagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggacuacaacaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgggggcuggagcaacccgaacuccaagcugcagaucaaccgccaggugaucguggaccgggggaaccggagcggcuacuccgggaucuucagcgucgagggcaaguccugcaucaaccgcugcuucuacguggagcucauccggggccgcaaggaggagaccgaggugcuguggaccagcaacagcaucgucguguucugcgggaccuccggcacguacgggaccggcagcuggcccgacggggccgacaucaaccugaugcccaucuga

SEQ ID NO: 82459 - RNA, 1410 nt, Artificial Sequence
  derived and/or modified sequence opt1 from neuraminidase__InfluenzaA__AEX33828
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaccguccacgaccgcacccccuaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggcccgacggcgccgacaucaaccugaugcccaucuga

SEQ ID NO: 82460 - RNA, 1410 nt, Artificial Sequence; identical to SEQ ID NO: 75720
  derived and/or modified sequence opt1 from neuraminidase__InfluenzaA__AEX33839

SEQ ID NO: 82461 - RNA, 1413 nt, Artificial Sequence
  derived and/or modified sequence opt1 from neuraminidase__InfluenzaA__AEX33861
augaaccccaaccagaagaucaucaccaucggcagcaucuccaucgccaucgggaccaucagccugaugcuccaggugggcaacaucaucuccaucugggccagccacuccauccagacggggagccagaaccacaccggcaucugcaaccagcgcaucaucaccuacgagaacuccaccugggucaaccacacguacgugaacaucaacaacaccaacguggucgcggggaaggacaagaccagcguggcccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcgcugauguccugcccccugggggaggcccccagcccguacaacagcaaguucgaguccguggccuggagcgccuccgcgugccacgacggcaugggcuggcucaccaucgggaucagcggccccgacaacggggccgucgccgugcugaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaagggccaggugaccaagagcguggagcucaacgcgcccaacuuccacuacgaggagugcuccugcuacccggacaccgggaccgucaugugcgugugccgcgacaacuggcacgggagcaaccggcccuggguguccuucaaccagaaccuggacuaccagaucggcuacaucugcagcggcgucuucggggacaacccccgccccaaggacggcaagggguccugcaacccggugacgguggacggcgccgacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucguccagcaccccgagcucaccggccuggacugcauccgccccugcuucuggguggagcuggugcgggggcucccgcgcgagaacaccaccaucuggacgagcggcuccagcaucuccuucugcggggucgacagcgacaccgccaacugguccuggcccgacggcgccgagcugcccuucaccaucgacaaguga

SEQ ID NO: 82462 - RNA, 1410 nt, Artificial Sequence
  derived and/or modified sequence opt1 from neuraminidase__InfluenzaA__AEX33872
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcagugcgagcccacgaucaucgagcgcaacaucaccgagaucguguaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccugaaccccaacaacgaggagggcgggcacggggucaagggcugggccuucgacgacgggaacgacguguggaugggccggaccaucagcgagaagcuccgccugggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 82463 - RNA, 1410 nt, Artificial Sequence; identical to SEQ ID NO: 75720
  derived and/or modified sequence opt1 from neuraminidase__InfluenzaA__AEX33883

SEQ ID NO: 82464 - RNA, 1410 nt, Artificial Sequence
  derived and/or modified sequence opt1 from neuraminidase__InfluenzaA__AEX33894
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucgacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82465 - RNA, 1413 nt, Artificial Sequence
  derived and/or modified sequence opt1 from neuraminidase__InfluenzaA__AEX33916
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagccgcuucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugagcuucaaccagaaccuggacuaccagaccggguacaucugcuccggcgucuucggcgacaacccccggcccaaggacggggagggcagcugcaacccgaugaccguggacggggcggacggcgugaagggguucuccuacaaguacggcaacggcgucuggaucgggcgcaccaagagcaaccggcugcgcaagggcuucgagaugaucugggaccccaacggguggacgaacaccgacuccgacuucagcgugaagcaggacguggucgccaucaccgacugguccggcuacagcgggagcuucgugcagcaccccgagcucaccggccuggacugcauccggcccugcuucuggguggagcugguccgcggccucccgcgggagaacacgaccaucuggaccuccgggagcuccaucagcuucugcggcgugaacuccgggaccgccaacuggagcuggcccgacggcgccgagcugcccuucacgaucgacaaguga

SEQ ID NO: 82466 - RNA, 1413 nt, Artificial Sequence; identical to SEQ ID NO: 76877
  derived and/or modified sequence opt1 from neuraminidase__InfluenzaA__AEX33927

SEQ ID NO: 82467 - RNA, 1413 nt, Artificial Sequence
  derived and/or modified sequence opt1 from neuraminidase__InfluenzaA__AEX33938
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccagccugugcuccaucagcggcugggccaucuacaccaaggacaacuccauccggaucggcagcaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccagcccguacaacagccgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggucaccaagaccaucgagcucaacgcccccaacuuccacuacgaggagugcagcugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcagcugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucagcgucaagcaggacgugguggcgaucaccgacugguccggcuacagcgggagcuucguccagcaccccgagcucaccggccuggacugcauccggcccugcuucuggguggagcugguccgcggccucccgcgggagaacaccacgaucuggaccuccgggagcuccaucagcuucugcggcgugaacuccgggaccaccaacuggagcuggcccgacggcgccgagcugcccuucacgaucgacaaguga

SEQ ID NO: 82468 - RNA, 1413 nt, Artificial Sequence
  derived and/or modified sequence opt1 from neuraminidase__InfluenzaA__AEX33949
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccagccugugcuccaucagcggcugggccaucuacaccaaggacaacuccauccggaucggcagcaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccagcccguacaacagccgcuucgaguccguggcguggagcgccuccgccugccacgacgggaugggcuggcucaccaucggcaucagcgggcccgacaacggcgccgucgcggugcugaaguacaacgggaucaucacggagaccgugaaguccuggaagaagcggauccugcgcacccaggagagcgagugcgucugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggugaugugcgucugccgggacaacuggcacggcuccaaccgccccugggugagcuucaaccagaaccuggacuaccagaucggguacaucugcuccggcguguucggcgacaacccccggcccaaggacggggagggcagcugcaacccggucaccguggacggggccgacggcgugaagggguucuccuacaaguacggcaacggcgucuggaucgggcgcaccaagagcaaccggcugcgcaagggcuucgagaugaucugggaccccaacggguggaccaacacggacuccgacuucagcgugaagcaggacguggucgcgaucaccgacugguccggcuacagcgggagcuucgugcagcaccccgagcucaccggccuggacugcauccggcccugcuucugggucgagcuggugcgcggccucccgcgggagaacaccacgaucuggaccuccgggagcuccaucagcuucugcggcgugaacuccgggaccgccaacuggagcuggcccgacggcgccgagcugcccuucaccaucgacaaguga

SEQ ID NO: 82469 - RNA, 1410 nt, Artificial Sequence
  derived and/or modified sequence opt1 from neuraminidase__InfluenzaA__AEX33971
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaccguguaccucaccaacaccacgaccgagaaggagaucugccccaagcuggcggaguaccggaacugguccaagccgcagugcgacaucaccggguucgcccccuucagcaaggacaacuccauccgccugagcgccggcggggacaucugggucacccgggagcccuacguguccugcgaccccgacaagugcuaccaguucgcccucggccaggggacgacccugaacaacgugcacagcaacgacaccguccacgaccgcaccccguaccggacgcugcucaugaacgagcugggcgugcccuuccaccugggcaccaagcaggucugcaucgccugguccagcuccagcugccacgacgggaaggcguggcuccacgugugcgugaccggcgacgacaagaacgccaccgccuccuucaucuacaacgggcgccugguggacagcaucgucuccuggagcaaggagauccugcggacgcaggaguccgagugcgugugcaucaacgggaccugcaccguggucaugaccgacgggagcgccagcggcaaggcggacacgaagauccucuucaucgaggagggcaagaucgugcacaccuccacccugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggcaucgugggcgacacgccccggaagaacgacuccagcuccagcucccacugccuggaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacagcaagcuccagaucaaccgccaggugaucguggaccggggcaaccgcuccggguacagcggcaucuucagcgucgaggggaaguccugcaucaaccggugcuucuacguggagcugauccgcggccggaaggaggagaccgaggugcuguggaccagcaacuccaucgucguguucugcggcacgagcgggaccuacggcaccggguccuggccggacggcgccgacaucaaccucaugcccaucuga

SEQ ID NO: 82470 - RNA, 1410 nt, Artificial Sequence
  derived and/or modified sequence opt1 from neuraminidase__InfluenzaA__AEX33993
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccguguga

SEQ ID NO: 82471 - RNA, 1410 nt, Artificial Sequence; identical to SEQ ID NO: 77520
  derived and/or modified sequence opt1 from neuraminidase__InfluenzaA__AEX34026

SEQ ID NO: 82472 - RNA, 1410 nt, Artificial Sequence
  derived and/or modified sequence opt1 from neuraminidase__InfluenzaA__AEX34036
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacggccgcaccccguaccggacccugcucaugaacgagcugggcgugcccuuccaccuggggacgaagcaggucugcaucgccugguccagcuccagcugccacgacggcaaggccuggcuccacgugugcgugaccggggacgacaagaacgcgaccgccuccuucaucuacaacggccgccugguggacagcaucgucuccuggagcaaggagauccugcggacccaggaguccgagugcgugugcaucaacgggacgugcgccguggucaugaccgacggcagcgccagcggcaaggcggacaccaagauccucuucaucgaggaggggaagaucgugcacaccuccacgcugagcggcuccgcccagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaagaacgacuccagcuccagcucccacugccucgaccccaacaacgaggagggcgggcacggcgucaaggggugggccuucgacgacggcgacgacguguggaugggccgcaccaucagcgagaagucccggagcggguacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcggccggaaggaggagaccgaggugcucuggaccagcaacuccaucgucguguucugcgggaccagcggcaccuacgggacgggcuccuggccggacggggccgacaucaaccugaugcccaucuga

SEQ ID NO: 82473 - RNA, 1410 nt, Artificial Sequence
  derived and/or modified sequence opt1 from neuraminidase__InfluenzaA__AEX34058
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcugacggaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 82474 - RNA, 1410 nt, Artificial Sequence
  derived and/or modified sequence opt1 from neuraminidase__InfluenzaA__AEX34103
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggaggucugccccaagcuggccgaguaccggaacugguccaagccgcagugcgacaucaccggguucgcgcccuucagcaaggacaacuccauccgccugagcgccggcggggacaucugggugacccgggagcccuacguguccugcgaccccgacaagugcuaccaguucgcccucggccaggggaccacgcugaacaacguccacagcaacgacaccgugcacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccuggucgacagcaucguguccuggagcaaggagauccugcggacccaggaguccgagugcgugugcaucaacggcacgugcaccgucgugaugaccgacgggagcgccagcggcaaggccgacaccaagauccucuucaucgaggagggcaagaucgugcacacguccacccugagcgggaacgcgcagcacgucgaggagugcuccugcuacccccgcuaccccggcgugcggugcgugugccgcgacaacuggaaggggagcaaccggccgaucgucgacaucaacaucaaggacuacuccaucgugagccgcuacgugugcuccggccuggucggcgacacgccccggaagaacgacagcuccagcuccagccacugccucgaccccaacaacgaggagggcgggcacggggugaagggcugggccuucgacgacgggaacgacgucuggaugggccgcaccaucuccgagaagucccggagcggcuacgagaccuucaaggugaucgagggguggagcaaccccaacuccaagcugcagaucaaccgccaggugaucgucgaccggggcaaccgcagcggguacuccggcaucuucagcguggagggcaagagcugcaucaaccggugcuucuacguggagcugauccgcgggcggaaggaggagaccaagguccucuggaccuccaacagcaucgugguguucugcggcaccuccgggacguacggcaccgggagcuggccggacggcgccgacaucaaccugaugcccaucuga

SEQ ID NO: 82475 - RNA, 1410 nt, Artificial Sequence
  derived and/or modified sequence opt1 from neuraminidase__InfluenzaA__AEX34114
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccccaccaacaccaccaucgagaaggagaucugcccgaagcucgcggaguaccggaacugguccaagccccagugcgacaucacgggguucgcccccuucagcaaggacaacuccauccgccugagcgccggcggggacaucugggucacccgggagcccuacguguccugcgacccggacaagugcuaccaguucgcccugggccaggggaccacccucaacaacgugcacagcaacgacacgguccacgaccgcacccccuaccggacccugcugaugaacgagcucggcgugcccuuccaccugggcaccaagcaggucugcaucgccugguccagcuccagcugccacgacgggaaggcguggcugcacgugugcgugacgggcgacgacaagaacgccaccgccuccuucaucuacaacgggcgccucguggacagcaucgucuccuggagcaaggagauccugcggacccaggaguccgagugcgugugcaucaacgggaccugcacgguggucaugaccgacgggagcgccagcggcaaggcggacaccaagauccuguucaucgaggagggcaagaucgugcacaccuccacgcucagcggguccgcccagcacguggaggagugcagcugcuacccccgcuacccgggcguccggugcgugugccgcgacaacuggaagggguccaaccggcccaucguggacaucaacaucaaggacuacagcaucgucucccgcuacgugugcagcggccuggugggcgacacgccccggaagaacgacuccagcuccagcucccacugccuggaccccaacaacgaggagggcggccacggggucaagggcugggccuucgacgacgggaacgacguguggaugggccgcaccaucagcgagaagucccggagcggcuacgagaccuucaaggucaucgaggggugguccaacccgaacagcaagcuccagaucaaccgccaggugaucguggaccggggcaaccgcuccggguacagcggcaucuucagcgucgaggggaaguccugcaucaaccggugcuucuacguggagcugauccgcggccggaaggaggagaccgaggugcuguggaccagcaacuccaucgucguguucugcggcaccagcgggaccuacggcacgggguccuggcccgacggcgccgacaucaaccucaugcccaucuga

SEQ ID NO: 82476 - RNA, 1410 nt, Artificial Sequence
  derived and/or modified sequence opt1 from neuraminidase__InfluenzaA__AEX34137
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 82477 - RNA, 1410 nt, Artificial Sequence
  derived and/or modified sequence opt1 from neuraminidase__InfluenzaA__AEX34191
augaaccccaaccagaagaucaucaccaucggcagcgugucccugagcaucuccaccaucugcuucuucaugcagaucgccauccucaucacgaccgucacccugcacuucaagcaguacgaguucaacagcuccccgaacaaccaggugaugcugugcgagcccaccaucaucgagcgcaacaucacggagaucguguaccucaccaacaccaccaucgagaaggagaucugccccaagcuggccgaguaccggaacuggagcaagccccagugcgacaucacgggguucgcgccguucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggacccccuaccgcacccugcucaugaacgagcugggcgugccguuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccaucgugagcugguccaaggagauccugcgcacccaggagagcgagugcgucugcaucaacgggaccugcacgguggugaugaccgacgggagcgccuccggcaaggccgacaccaagauccucuucaucgaggagggcaagaucguccacaccagcacgcuguccgggagcgcgcagcacguggaggagugcuccugcuacccccgguaccccggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacagcggcaucuucuccguggagggcaagagcugcaucaaccggugcuucuacgucgagcucauccgcgggcggaaggaggagacggaggugcuguggaccuccaacagcaucguggucuucugcggcaccuccgggaccuacggcacggggagcuggcccgacggcgccgacaucaaccugaugccgaucuga

SEQ ID NO: 82478 - RNA, 1410 nt, Artificial Sequence
  derived and/or modified sequence opt1 from neuraminidase__InfluenzaA__AEX34224
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacggccgcaccccguaccggacccugcucaugaacgagcugggcgugcccuuccaccuggggacgaagcaggucugcaucgccugguccagcuccagcugccacgacggcaaggccuggcuccacgugugcgugaccggggacgacaagaacgcgaccgccuccuucaucuacaacggccgccugguggacagcaucgucuccuggagcaaggagauccugcggacccaggaguccgagugcgugugcaucaacgggacgugcaccguggucaugaccgacggcagcgccagcggcaaggccgacaccaagauccucuucaucgaggaggggaagaucgugcacacguccacccugagcggcuccgcgcagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagcugcgguccggguacgagaccuucaaggucaucgagggcuggagcaaccccaacuccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 82479 - RNA, 1410 nt, Artificial Sequence
  derived and/or modified sequence opt1 from neuraminidase__InfluenzaA__AEX34235
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaaguccgacagcuccagcuccagccacugccucgaccccaacaacgaggagggcggccacggggucaagggcugggccuucgacgacgggaacgacguguggaugggccgcaccaucuccgagaagucccggagcggcuacgagaccuucaaggucaucgagggguggagcaaccccaacuccaagcugcagaucaaccgccaggugaucguggaccggggcaaccgcagcggguacagcggcaucuucuccgucgagggcaagagcugcaucaaccggugcuucuacguggagcugauccgcgggcggaaggaggagaccgaggugcucuggaccuccaacagcaucgucguguucugcggcaccuccgggaccuacggcacggggagcuggccggacggcgccgacaucaaccugaugcccaucuga

SEQ ID NO: 82480 - RNA, 1410 nt, Artificial Sequence
  derived and/or modified sequence opt1 from neuraminidase__InfluenzaA__AEX34246
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcaggucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 82481 - RNA, 1410 nt, Artificial Sequence
  derived and/or modified sequence opt1 from neuraminidase__InfluenzaA__AEX34257
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcaaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcaucguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 82482 - RNA, 1410 nt, Artificial Sequence
  derived and/or modified sequence opt1 from neuraminidase__InfluenzaA__AEX34268
augaaccccaacaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcaagcuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggaccuacggcacggggagcuggccggacggcgccgacaucaaccugaugcccaucuga

SEQ ID NO: 82483 - RNA, 1410 nt, Artificial Sequence
  derived and/or modified sequence opt1 from neuraminidase__InfluenzaA__AEX34278
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgagaagggcggccacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 82484 - RNA, 1413 nt, Artificial Sequence
  derived and/or modified sequence opt1 from neuraminidase__InfluenzaA__AEX34310
augaaccccaaccagaagaucaucaccaucggcagcaucuccaucgccaucgggaucaucagccugaugcuccagaucggcaacaucaucuccaucugggccagccacuccauccagaccgggacgcagaaccacaccggcaucugcaaccagcgcaucaucaccuacgagaacagcaccugggugaaccacacguacgucaacaucaacaacaccaacgugguggcggggaaggacaagaccccggucacccuggugggcaacuccagccugugcuccaucagcggcugggccaucuacacgaaggacaacuccauccggaucgggagcaagggcgacguguucgucauccgcgagcccuucaucuccugcagccaccucgagugcaagaccuucuuccugacccagggggcccugcucaacgacaagcacuccaacggcaccgugaaggaccggagccccuaccgcgcccugauguccugcccccugggggaggccccgagccccuacaacuccaaguucgagagcguggcguggagcgccuccgccugccacgacggcaucggcuggcucacgaucgggaucagcggccccgacaacggggccgucgcggugcugaaguacaagggcaucaucaccggcaccaucaaguccuggaagaagcagauccugcggacccaggagagcgagugcgugugcaugaacggguccugcuucacgaucaugaccgacggccccagcaacggggccgccuccuacaagaucuucaagaucgagaagggcaaggucaccaagagcauggagcucaacgccccgaacuuccacuacgaggagugcuccugcuaccccgacaccgggacggugaugugcgugugccgcgacaacuggcacggcagcaaccggcccugggucuccuucaaccagaaccuggacuaccagaucggcuacaucugcagcgggguguucggcgacaacccccgcccgaaggaccgggagggguccugcaaccccgugaccgucgacggcgccaacggggugaagggcuucagcuacaaguacggcaacgggguguggaucggccgcaccaaguccaaccggauccgcaagggguucgagaugaucugggaccccaacggcuggaccaacacggacagcgacuucuccgucaagcaggacaucguggcgaucaccgacuggagcggguacuccggcagcuucgugcagcaccccgagcugaccggccucgacugcauccggccgugcuucugggucgagcuggugcgcgggcugcccggcgagaacaccacgaucuggaccagcggguccagcaucuccuucugcggcgucaacggcgacaucgccaacuggagcuggcccgacggggccgagcuccccuucaccaucgacaaguga

SEQ ID NO: 82485 - RNA, 1413 nt, Artificial Sequence
  derived and/or modified sequence opt1 from neuraminidase__InfluenzaA__AEX34321
augaaccccaaccagaagaucaucaccaucggcagcaucuccaucgccaucgggaucaucagccugaugcuccagaucggcaacaucaucuccaucugggugagccacuccauccagaccgggagccagaacaacacgggcaucugcaaccagcgcaucaucaccuacgagaacuccaccugggucaaccacaccuacgugaacaucaacaacacgaacguggucgccggggaggacaagaccagcgugacccuggcgggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccagcccguacaacagcaaguucgaguccguggcguggagcgccuccgccugccacgacggcaugggcuggcucaccaucgggaucagcggccccgacaacggggccgucgcggugcugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggucaccaagagcaucgagcucaacgcccccaacuucuacuacgaggagugcuccugcuacccggacaccggcaucgugaugugcgugugccgggacaacuggcacgggagcaaccgccccugggucuccuucaaccagaaccuggacuaccagaucggcuacaucugcagcggcguguucggggacaacccccggcccgaggacggcgagggguccugcaacccggugaccgucgacggcgccaacggggugaagggcuucagcuacaaguacggcaacgggguguggaucggccgcacgaaguccaaccggcugcgcaagggguucgagaugaucugggaccccaacggcuggaccaacaccgacagcgacuucuccgucaagcaggacgugguggcgaucaccgacuggagcggguacagcggcuccuucguccagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 82486 - RNA, 1410 nt, Artificial Sequence; identical to SEQ ID NO: 77065
  derived and/or modified sequence opt1 from neuraminidase__InfluenzaA__AEX34356

SEQ ID NO: 82487 - RNA, 1410 nt, Artificial Sequence
  derived and/or modified sequence opt1 from neuraminidase__InfluenzaA__AEX34367
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgaagcacguggaggagugcuccugcuacccccggcaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 82488 - RNA, 1410 nt, Artificial Sequence
  derived and/or modified sequence opt1 from neuraminidase__InfluenzaA__AEX34378
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaaccuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgaagcacguggaggagugcuccugcuacccccggcaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 82489 - RNA, 1410 nt, Artificial Sequence
  derived and/or modified sequence opt1 from neuraminidase__InfluenzaA__AEX34400
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucaaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 82490 - RNA, 1413 nt, Artificial Sequence
  derived and/or modified sequence opt1 from neuraminidase__InfluenzaA__AEX34432
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccagccugugcuccaucagcggcugggccaucuacaccaaggacaacuccauccggaucggcagcaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccagcccguacaacagccgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagagcgagugcgugugcaugaacggcuccugcuucaccaucaugacggacggccccagcaacgggaccgccuccuacaagaucuucaagaucgagaagggcaaggucaccaagaccaucgagcucaacgcccccaacuuccacuacgaggagugcagcugcuacccggacacggggaccgugaugugcgugugccgggacaacuggcacggcuccaaccgccccugggucagcuucaaccagaaccuggacuaccagaucggguacaucugcuccggcguguucggcgacaacccccggcccaaggacggggagggcagcugcaacccggugaccgucgacggggccgacggcgugaagggguucuccuacaaguacggcaacggcguguggaucgggcgcaccaagagcaaccggcugcgcaagggcuucgagaugaucugggaccccaacggguggacgaacaccgacuccgacuucagcgucaagcaggacgugguggccaucaccgacugguccggcuacagcgggagcuucguccagcaccccgagcucaccggccuggacugcauccggcccugcuucuggguggagcugguccgcggccucccgcgggagaacacgaccaucuggaccuccgggagcuccaucagcuucugcggcgugaacuccgggaccgcgaacuggagcuggcccgacggcgccgagcugcccuucacgaucgacaaguga

SEQ ID NO: 82491 - RNA, 1413 nt, Artificial Sequence; identical to SEQ ID NO: 82490
  derived and/or modified sequence opt1 from neuraminidase__InfluenzaA__AEX34443

SEQ ID NO: 82492 - RNA, 1410 nt, Artificial Sequence; identical to SEQ ID NO: 77611
  derived and/or modified sequence opt1 from neuraminidase__InfluenzaA__AEX34454

SEQ ID NO: 82493 - RNA, 1413 nt, Artificial Sequence
  derived and/or modified sequence opt1 from neuraminidase__InfluenzaA__AEX34465
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacgggaucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcaugcgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 82494 - RNA, 1413 nt, Artificial Sequence; identical to SEQ ID NO: 82447
  derived and/or modified sequence opt1 from neuraminidase__InfluenzaA__AEX34476

SEQ ID NO: 82495 - RNA, 1413 nt, Artificial Sequence; identical to SEQ ID NO: 82449
  derived and/or modified sequence opt1 from neuraminidase__InfluenzaA__AEX34487

SEQ ID NO: 82496 - RNA, 1413 nt, Artificial Sequence; identical to SEQ ID NO: 82449
  derived and/or modified sequence opt1 from neuraminidase__InfluenzaA__AEX34498

SEQ ID NO: 82497 - RNA, 1413 nt, Artificial Sequence; identical to SEQ ID NO: 82449
  derived and/or modified sequence opt1 from neuraminidase__InfluenzaA__AEX34509

SEQ ID NO: 82498 - RNA, 1413 nt, Artificial Sequence; identical to SEQ ID NO: 82449
  derived and/or modified sequence opt1 from neuraminidase__InfluenzaA__AEX34520

SEQ ID NO: 82499 - RNA, 1413 nt, Artificial Sequence; identical to SEQ ID NO: 82449
  derived and/or modified sequence opt1 from neuraminidase__InfluenzaA__AEX34531

SEQ ID NO: 82500 - RNA, 1413 nt, Artificial Sequence; identical to SEQ ID NO: 82449
  derived and/or modified sequence opt1 from neuraminidase__InfluenzaA__AEX34542

SEQ ID NO: 82501 - RNA, 1413 nt, Artificial Sequence; identical to SEQ ID NO: 82449
  derived and/or modified sequence opt1 from neuraminidase__InfluenzaA__AEX34553

SEQ ID NO: 82502 - RNA, 1413 nt, Artificial Sequence; identical to SEQ ID NO: 82449
  derived and/or modified sequence opt1 from neuraminidase__InfluenzaA__AEX34564

SEQ ID NO: 82503 - RNA, 1413 nt, Artificial Sequence; identical to SEQ ID NO: 82449
  derived and/or modified sequence opt1 from neuraminidase__InfluenzaA__AEX34575

SEQ ID NO: 82504 - RNA, 1413 nt, Artificial Sequence; identical to SEQ ID NO: 82449
  derived and/or modified sequence opt1 from neuraminidase__InfluenzaA__AEX34586

SEQ ID NO: 82505 - RNA, 1413 nt, Artificial Sequence; identical to SEQ ID NO: 82449
  derived and/or modified sequence opt1 from neuraminidase__InfluenzaA__AEX34597

SEQ ID NO: 82506 - RNA, 1413 nt, Artificial Sequence; identical to SEQ ID NO: 82449
  derived and/or modified sequence opt1 from neuraminidase__InfluenzaA__AEX34608

SEQ ID NO: 82507 - RNA, 1413 nt, Artificial Sequence; identical to SEQ ID NO: 82449
  derived and/or modified sequence opt1 from neuraminidase__InfluenzaA__AEX34619

SEQ ID NO: 82508 - RNA, 1413 nt, Artificial Sequence; identical to SEQ ID NO: 82449
  derived and/or modified sequence opt1 from neuraminidase__InfluenzaA__AEX34630

SEQ ID NO: 82509 - RNA, 1413 nt, Artificial Sequence; identical to SEQ ID NO: 82449
  derived and/or modified sequence opt1 from neuraminidase__InfluenzaA__AEX34641

SEQ ID NO: 82510 - RNA, 1413 nt, Artificial Sequence
  derived and/or modified sequence opt1 from neuraminidase__InfluenzaA__AEX34653
augaaccccaaccagaagaucaucaccaucggcagcaucuccaucgccaucgggaucaucagccugaugcuccaggugggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcguggcccuggccggcaacuccagccugugcuccaucagcggcugggccaucuacaccaaggacaacuccauccggaucgggagcaagggcgacguguucgucauccgcgagccguucaucuccugcagccaccucgagugccggaccuucuuccugacgcagggggcccugcucaacgacaagcacuccaacggcaccgugaaggaccgcagccccuaccgggcgcugauguccugcccccugggggaggcccccagcccguacaacagcaaguucgaguccguggccuggagcgccuccgcgugccacgacggccucggcuggcugaccaucgggaucagcggccccgacaacggggccgucgccgugcugaaguacaacggcaucaucaccgagacgaucaaguccuggaagaagcgcauccuccggacccaggagagcgagugcgugugcgucaacggcuccugcuucaccaucaugaccgacgggcccagcaacggcgccgccuccuacaagaucuucaagaucgagaagggccaggugaccaagagcguggagcugaacgcgcccaacuuccacuacgaggagugcuccugcuacccggacacggggaccgucaugugcgugugccgcgacaacuggcacgggagcaaccggcccuggguguccuucaaccaggaccuggacuaccagaucggcuacaucugcagcggcgucuucggggacaacccccgccccaaggacggcaagggguccugcaacccggugaccguggacggcgccgacggggucaagggcuucagcuacaaguacggcaacgggguguggaucggccggacgaaguccaaccgccuccggaagggguucgagaugaucugggaccccaacggcuggaccgacaccgacagcgacuucuccgugaagcaggacgucguggccaucaccgacuggagcggguacagcggcuccuucguccagcaccccgagcugacgggccuggacugcauccgccccugcuucuggguggagcucgugcgggggcugccgcgcgagaacaccaccaucuggaccagcggcuccagcaucuccuucugcggggucgacagcgacacggccaacugguccuggcccgacggcgccgagcugcccuucaccaucgacaaguga

SEQ ID NO: 82511 - RNA, 1413 nt, Artificial Sequence
  derived and/or modified sequence opt1 from neuraminidase__InfluenzaA__AEX34664
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagccgcgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcaagggguccugcaacccggugacggcggacggcgccgacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucgacagcgacaccgccaacugguccuggcccgacggcgccgagcugcccuucaccaucgacaaguga

SEQ ID NO: 82512 - RNA, 1413 nt, Artificial Sequence; identical to SEQ ID NO: 82490
  derived and/or modified sequence opt1 from neuraminidase__InfluenzaA__AEX34686

SEQ ID NO: 82513 - RNA, 1413 nt, Artificial Sequence
  derived and/or modified sequence opt1 from neuraminidase__InfluenzaA__AEX34760
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccagccugugcuccaucagcggcugggccaucuacaccaaggacaacuccauccggaucggcagcaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccagcccguacaacagccgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggucaccaagaccaucgagcucaacgcccccaacuuccacuacgaggagugcagcugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcagcugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucagcgucaagcaggacgugguggcgaucaccgacugguccggcuacagcgggagcuucguccagcaccccgagcucaccggccuggacugcauccggcccugcuucuggguggagcugguccgcggccucccgcgggagaacaccacgaucuggaccuccgggagcuccaucagcuucugcggcgugaacuccgggaccgugaacuggagcuggcccgacggcgccgagcugcccuucaccaucgacaaguga

SEQ ID NO: 82514 - RNA, 1413 nt, Artificial Sequence
  derived and/or modified sequence opt1 from neuraminidase__InfluenzaA__AEX34771
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggucgagaaggacaagaccagcgugacccuggcggggaacuccagccugugcuccaucagcggcugggccaucuacaccaaggacaacuccauccggaucggcagcaagggggacguguucgucauccgcgagccguucaucuccugcagccaccucgagugccggacguucuuccugacccagggcgcccugcucaacgacaagcacuccaacgggaccgugaaggaccgcagccccuaccgggcccugauguccugcccccugggcgaggcccccagcccguacaacagccgcuucgaguccguggcguggagcgccuccgccugccacgacgggaugggcuggcucaccaucggcaucagcgggcccgacaacggcgccgucgcggugcugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggucaccaagaccaucgagcucaacgcccccaacuuccacuacgaggagugcagcugcuacccggacaccgggacggugaugugcgugugccgggacaacuggcacggcuccaaccgccccugggucagcuucaaccagaaccuggacuaccagaucggguacaucugcuccggcguguucggcgacaacccccggcccaaggacggggagggcagcugcaacccggugaccgucgacggggccgacggcgugaagggguucuccuacaaguacggcaacggcguguggaucgggcgcaccaagagcaaccggcugcgcaagggcuucgagaugaucugggaccccaacggguggaccaacacggacuccgacuucagcgucaagcaggacgugguggcgaucaccgacugguccggcuacagcgggagcuucguccagcaccccgagcucaccggccuggacugcauccggcccugcuucuggguggagcugguccgcggccucccgcgggagaacaccacgaucuggaccuccgggagcuccaucagcuucugcggcgugaacuccgggaccgccaacuggagcuggcccgacggcgccgagcugcccuucaccaucgacaaguga

SEQ ID NO: 82515 - RNA, 1413 nt, Artificial Sequence; identical to SEQ ID NO: 78469
  derived and/or modified sequence opt1 from neuraminidase__InfluenzaA__AEX34782

SEQ ID NO: 82516 - RNA, 1413 nt, Artificial Sequence
  derived and/or modified sequence opt1 from neuraminidase__InfluenzaA__AEX34793
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccggaucggguccaagggcgacguguucgucauccgcgagcccuucaucagcugcucccaccucgagugcaagacguucuuccugacccagggggcccugcucaacgacaagcacagcaacggcaccgugaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucagcuucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucagcgucaagcaggacaucguggcgaucacggacugguccggguacagcggcagcuucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 82517 - RNA, 1413 nt, Artificial Sequence; identical to SEQ ID NO: 82516
  derived and/or modified sequence opt1 from neuraminidase__InfluenzaA__AEX34804

SEQ ID NO: 82518 - RNA, 1413 nt, Artificial Sequence
  derived and/or modified sequence opt1 from neuraminidase__InfluenzaA__AEX34815
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccugaccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcccccagcccguacaacagcaaguucgaguccguggcguggagcgccuccgccugccacgacggcaugggcuggcucacgaucgggaucagcggccccgacaacggggccguggcgguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 82519 - RNA, 1413 nt, Artificial Sequence; identical to SEQ ID NO: 82516
  derived and/or modified sequence opt1 from neuraminidase__InfluenzaA__AEX34826

SEQ ID NO: 82520 - RNA, 1413 nt, Artificial Sequence; identical to SEQ ID NO: 82516
  derived and/or modified sequence opt1 from neuraminidase__InfluenzaA__AEX34837

SEQ ID NO: 82521 - RNA, 1413 nt, Artificial Sequence
  derived and/or modified sequence opt1 from neuraminidase__InfluenzaA__AEX34859
augaaccccaaccagaagaucaucaccaucggcagcaccuccaucgccaucgggaucaucagccugaugcuccagaucggcaacaucaucuccaucugggccagccacuccauccagacggggagccagaaccacaccggcaucugcaaccagcgcaucaucaccuacgagaacuccaccugggugaaccacacguacgucaacaucaacaacaccaacgugguggcggggaaggacaagaccccggucacccugaucggcaacagcucccugugcagcaucuccggcugggccaucuacacgaaggacaacagcauccggaucggguccaagggcgacguguucgugauccgcgagcccuucaucagcugcucccaccucgagugcaagaccuucuuccugacccagggggcccugcucaacgacaagcacagcaacggcaccgucaaggaccggucccccuaccgcgcccugaugagcugcccccugggggaggccccgucccccuacaacagcaaguucgagagcguggcgugguccgccagcgccugccacgacggcaucggcuggcucacgaucgggaucuccggccccgacaacggggccguggcgguccugaaguacaagggcaucaucaccggcaccaucaagagcuggaagaagcagauccugcggacccaggaguccgagugcgugugcaugaacgggagcugcuucacgaucaugaccgacggccccuccaacggggccgccagcuacaagaucuucaagaucgagaagggcaaggugaccaaguccauggagcucaacgccccgaacuuccacuacgaggagugcagcugcuaccccgacaccgggacggucaugugcgugugccgcgacaacuggcacggcuccaaccggcccugggugagcuucaaccagaaccuggacuaccagaucggcuacaucugcuccggggucuucggcgacaacccccgcccgaaggaccgggaggggagcugcaaccccgugaccguggacggcgccaacggggucaagggcuucuccuacaaguacggcaacgggguguggaucggccgcaccaagagcaaccggauccgcaagggguucgagaugaucugggaccccaacggcuggaccaacacggacuccgacuucagcgugaagcaggacaucgucgcgaucaccgacugguccggguacagcggcagcuucgugcagcaccccgagcugaccggccucgacugcauccggccgugcuucuggguggagcugguccgcgggcugccccgggagaacaccacgaucuggaccuccggcagcuccaucagcuucugcggggugaacggcgacaucgccaacugguccuggcccgacggcgccgagcuccccuucaccaucgacaaguga

SEQ ID NO: 82522 - RNA, 1413 nt, Artificial Sequence
  derived and/or modified sequence opt1 from neuraminidase__InfluenzaA__AEX34870
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaucagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaucggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 82523 - RNA, 1413 nt, Artificial Sequence
  derived and/or modified sequence opt1 from neuraminidase__InfluenzaA__AEX34881
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaaggccccggucacccugaucggcaacagcucccugugcagcaucuccggcugggccaucuacaccaaggacaacagcauccggaucggguccaagggcgacguguucgugauccgcgagcccuucaucagcugcucccaccucgagugcaagaccuucuuccugacgcagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaagggcaucaucaccggcacgaucaagagcuggaagaagcagauccugcggacccaggaguccgagugcgugugcaugaacgggagcugcuucaccaucaugaccgacggccccuccaacggggccgccagcuacaagaucuucaagaucgagaagggcaaggugacgaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccgaaggaccgggaggggagcugcaaccccgugaccguggacggcgcgaacggggucaagggcuucuccuacaaguacggcaacgggguguggaucggccgcaccaagagcaaccggauccgcaagggguucgagaugaucugggaccccaacggcuggacgaacaccgacuccgacuucagcgugaagcaggacaucgucgccaucaccgacugguccggguacagcggcagcuucgugcagcaccccgagcugacgggccucgacugcauccggccgugcuucuggguggagcugguccgcgggcugccccgggagaacaccaccaucuggaccuccggcagcuccaucagcuucugcggggugaacggcgacaucgccaacugguccuggcccgacggcgccgagcuccccuucacgaucgacaaguga

SEQ ID NO: 82524 - RNA, 1413 nt, Artificial Sequence
  derived and/or modified sequence opt1 from neuraminidase__InfluenzaA__AEX34892
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcagaacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 82525 - RNA, 1413 nt, Artificial Sequence
  derived and/or modified sequence opt1 from neuraminidase__InfluenzaA__AEX34903
augaaccccaaccagaagaucaucaccaucggcagcaucuccaucgccaucgggaucaucagccugaugcuccagaucggcaacaucaucuccaucugggccagccgcuccauccagaccgggagccagaaccacacgggcaucugcaaccagcggaucaucaccuacgagaacuccaccugggugaaccacaccuacgucaacaucaacaacacgaacgugguggcggggaaggacaagaccccggucacccuggugggcaacagcucccugugcagcaucuccggcugggccaucuacaccaaggacaacagcauccgcaucggguccaagggcgacguguucgucauccgggagcccuucaucagcugcucccaccucgagugcaagacguucuuccugacccagggggcccugcucaacgacaagcacagcaacggcaccgugaaggaccgcucccccuaccgggcccugaugagcugcccccugggggaggccccgucccccuacaacagcaaguucgagagcguggcgugguccgccagcgccugccacgacggcaucggcuggcucaccaucgggaucuccggccccgacaacggggccgucgcggugcugaaguacaagggcaucaucacgggcaccaucaagagcuggaagaagcagauccugcgcacccaggaguccgagugcgugugcaugaacgggagcugcuucaccaucaugacggacggccccuccaacggggccgccagcuacaagaucuucaagaucgagaagggcaaggucaccaaguccauggagcucaacgccccgaacuuccacuacgaggagugcagcugcuaccccgacaccgggaccgugaugugcgugugccgggacaacuggcacggcuccaaccgccccugggucagcuucaaccagaaccuggacuaccagaucggcuacaucugcuccgggguguucggcgacaacccccggccgaaggaccgcgaggggagcugcaaccccgugacggucgacggcgccaacggggugaagggcuucuccuacaaguacggcaacgggguguggaucggccggaccaagagcaaccgcauccggaagggguucgagaugaucugggaccccaacggcuggaccaacaccgacuccgacuucagcguccgccaggacaucguggcgaucacggacugguccggguacagcggcagcuucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 82526 - RNA, 1413 nt, Artificial Sequence; identical to SEQ ID NO: 78469
  derived and/or modified sequence opt1 from neuraminidase__InfluenzaA__AEX34914

SEQ ID NO: 82527 - RNA, 1413 nt, Artificial Sequence; identical to SEQ ID NO: 78469
  derived and/or modified sequence opt1 from neuraminidase__InfluenzaA__AEX34925

SEQ ID NO: 82528 - RNA, 1413 nt, Artificial Sequence; identical to SEQ ID NO: 78469
  derived and/or modified sequence opt1 from neuraminidase__InfluenzaA__AEX34936

SEQ ID NO: 82529 - RNA, 1413 nt, Artificial Sequence; identical to SEQ ID NO: 78469
  derived and/or modified sequence opt1 from neuraminidase__InfluenzaA__AEX34947

SEQ ID NO: 82530 - RNA, 1413 nt, Artificial Sequence; identical to SEQ ID NO: 78469
  derived and/or modified sequence opt1 from neuraminidase__InfluenzaA__AEX34958

SEQ ID NO: 82531 - RNA, 1413 nt, Artificial Sequence; identical to SEQ ID NO: 78469
  derived and/or modified sequence opt1 from neuraminidase__InfluenzaA__AEX34969

SEQ ID NO: 82532 - RNA, 1413 nt, Artificial Sequence; identical to SEQ ID NO: 78469
  derived and/or modified sequence opt1 from neuraminidase__InfluenzaA__AEX34980

SEQ ID NO: 82533 - RNA, 1413 nt, Artificial Sequence; identical to SEQ ID NO: 78469
  derived and/or modified sequence opt1 from neuraminidase__InfluenzaA__AEX34991

SEQ ID NO: 82534 - RNA, 1413 nt, Artificial Sequence
  derived and/or modified sequence opt1 from neuraminidase__InfluenzaA__AEX35002
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccugaucggcaacagcucccugugcagcaucuccggcugggccaucuacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggccccgucccccuacaacagcaaguucgagagcguggcgugguccgccagcgccugccacgacggcaucggcuggcucaccaucgggaucuccggccccgacaacggggccguggcgguccugaaguacaagggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccgaaggaccgggaggggagcugcaaccccgugacgguggacggcgccaacggggucaagggcuucuccuacaaguacggcaacgggguguggaucggccgcaccaagagcaaccggauccgcaagggguucgagaugaucugggaccccaacggcuggaccaacaccgacuccgacuucagcgugaagcaggacaucgucgcgaucacggacugguccggguacagcggcagcuucgugcagcaccccgagcugaccggccucgacugcauccggccgugcuucuggguggagcugguccgcgggcugccccgggagaacaccaccaucuggacguccggcagcuccaucagcuucugcggggugaacggcgacaucgccaacugguccuggcccgacggcgccgagcuccccuucaccaucgacaaguga

SEQ ID NO: 82535 - RNA, 1413 nt, Artificial Sequence; identical to SEQ ID NO: 78469
  derived and/or modified sequence opt1 from neuraminidase__InfluenzaA__AEX35013

SEQ ID NO: 82536 - RNA, 1413 nt, Artificial Sequence; identical to SEQ ID NO: 78469
  derived and/or modified sequence opt1 from neuraminidase__InfluenzaA__AEX35024

SEQ ID NO: 82537 - RNA, 1413 nt, Artificial Sequence; identical to SEQ ID NO: 78469
  derived and/or modified sequence opt1 from neuraminidase__InfluenzaA__AEX35035

SEQ ID NO: 82538 - RNA, 1413 nt, Artificial Sequence; identical to SEQ ID NO: 78469
  derived and/or modified sequence opt1 from neuraminidase__InfluenzaA__AEX35046

SEQ ID NO: 82539 - RNA, 1413 nt, Artificial Sequence; identical to SEQ ID NO: 78469
  derived and/or modified sequence opt1 from neuraminidase__InfluenzaA__AEX35057

SEQ ID NO: 82540 - RNA, 1413 nt, Artificial Sequence; identical to SEQ ID NO: 78469
  derived and/or modified sequence opt1 from neuraminidase__InfluenzaA__AEX35068

SEQ ID NO: 82541 - RNA, 1413 nt, Artificial Sequence
  derived and/or modified sequence opt1 from neuraminidase__InfluenzaA__AEX35079
augaaccccaaccagaagaucaucaccaucggcagcaucuccaucgccaucgggaucaucagccugaugcuccagaucggcaacaucaucuccaugugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccaggaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 82542 - RNA, 1413 nt, Artificial Sequence; identical to SEQ ID NO: 82516
  derived and/or modified sequence opt1 from neuraminidase__InfluenzaA__AEX35090

SEQ ID NO: 82543 - RNA, 1413 nt, Artificial Sequence
  derived and/or modified sequence opt1 from neuraminidase__InfluenzaA__AEX35101
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcguguucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 82544 - RNA, 1413 nt, Artificial Sequence
  derived and/or modified sequence opt1 from neuraminidase__InfluenzaA__AEX35112
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgccuccaacuucuacuacgaggagugcagcugcuaccccgacaccggcaucgucaugugcgugugccgggacaacuggcacggguccaaccgcccgugggugagcuucaaccagaaccuggacuaccagaucggcuacaucugcuccggcgucuucggggacaacccccggcccgaggacggcgaggggagcugcaaccccgugaccguggacggcgcgaacggggucaagggcuucuccuacaaguacggcaacgggguguggaucggccgcaccaagagcaaccggcugcgcaagggguucgagaugaucugggacccgaacggcuggacgaacaccgacuccgacuucagcgugaagcaggacgucguggccaucaccgacuggagcggguacuccggcagcuucgugcagcaccccgagcucacgggccuggacugcauccggcccugcuucugggucgagcuggugcgcgggcucccccgggagaacaccaccaucuggaccuccggcagcuccaucagcuucugcggggucaacuccgacacggccaacuggagcuggccggacggcgccgagcugcccuucaccaucgacaaguga

SEQ ID NO: 82545 - RNA, 1413 nt, Artificial Sequence; identical to SEQ ID NO: 78469
  derived and/or modified sequence opt1 from neuraminidase__InfluenzaA__AEX35123

SEQ ID NO: 82546 - RNA, 1413 nt, Artificial Sequence
  derived and/or modified sequence opt1 from neuraminidase__InfluenzaA__AEX35145
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacaucgucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 82547 - RNA, 1413 nt, Artificial Sequence; identical to SEQ ID NO: 82516
  derived and/or modified sequence opt1 from neuraminidase__InfluenzaA__AEX35156

SEQ ID NO: 82548 - RNA, 1413 nt, Artificial Sequence; identical to SEQ ID NO: 78469
  derived and/or modified sequence opt1 from neuraminidase__InfluenzaA__AEX35167

SEQ ID NO: 82549 - RNA, 1413 nt, Artificial Sequence
  derived and/or modified sequence opt1 from neuraminidase__InfluenzaA__AEX35178
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaaggagcgcauccugcggacccaggagagcgagugcgugugcgugaacggcuccugcuucaccaucaugacggacgggcccagcaacggcgccgccuccuacaagaucuucaagaucgagaaggggaaggucaccaagagccgcgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcaagggguccugcaacccggugacggcggacggcgccgacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucgacagcgacaccgccaacugguccuggcccgacggcgccgagcugcccuucaccaucgacaaguga

SEQ ID NO: 82550 - RNA, 1413 nt, Artificial Sequence; identical to SEQ ID NO: 82490
  derived and/or modified sequence opt1 from neuraminidase__InfluenzaA__AEX35189

SEQ ID NO: 82551 - RNA, 1413 nt, Artificial Sequence; identical to SEQ ID NO: 82490
  derived and/or modified sequence opt1 from neuraminidase__InfluenzaA__AEX35200

SEQ ID NO: 82552 - RNA, 1413 nt, Artificial Sequence; identical to SEQ ID NO: 78469
  derived and/or modified sequence opt1 from neuraminidase__InfluenzaA__AEX35211

SEQ ID NO: 82553 - RNA, 1410 nt, Artificial Sequence
  derived and/or modified sequence opt1 from neuraminidase__InfluenzaA__AEX35222
augaaccccaaccagaagaucaucaccaucggcagcgugucccugaccaucagcacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacgagaacgcgaccgccagcuucaucuacaacggccgccugguggacuccaucgggagcugguccaagaagauccugcggacccaggagagcgagugcgucugcaucaacggcacgugcaccguggugaugaccgacggcuccgccagcgggaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcuggugggcgacacgccccgcaagaacgacuccagcuccagcucccacugccucgaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcugcagaucaaccggcaggucaucguggaccgcggcaaccggagcggguacuccggcaucuucagcguggagggcaagagcugcaucaaccgcugcuucuacgucgagcucauccgggggcgcaagcaggagaccgaggugcuguggaccuccaacagcaucguggucuucugcggcaccuccgggacguacggcaccgggagcuggccggacggcgccgacaucaaccugaugcccaucuga

SEQ ID NO: 82554 - RNA, 1413 nt, Artificial Sequence; identical to SEQ ID NO: 82449
  derived and/or modified sequence opt1 from neuraminidase__InfluenzaA__AEX35233

SEQ ID NO: 82555 - RNA, 1410 nt, Artificial Sequence
  derived and/or modified sequence opt1 from neuraminidase__InfluenzaA__AEX35244
augaaccccaaccagaagaucaucaccaucggcagcgugucccugaccaucagcacgaucugcuucuucaugcagaucgccauccucaucaacaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggccgaguaccggaacuggagcaagccgcagugcaacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggcaacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaacgaggugcuguggaccuccaacagcaucgucguguucugcggcaccuccgggaccuacggcaccgggagcuggccggacggcgccgacaucaaccugaugcccguguga

SEQ ID NO: 82556 - RNA, 1410 nt, Artificial Sequence; identical to SEQ ID NO: 76937
  derived and/or modified sequence opt1 from neuraminidase__InfluenzaA__AEX35255

SEQ ID NO: 82557 - RNA, 1413 nt, Artificial Sequence; identical to SEQ ID NO: 82449
  derived and/or modified sequence opt1 from neuraminidase__InfluenzaA__AEX35266

SEQ ID NO: 82558 - RNA, 1413 nt, Artificial Sequence; identical to SEQ ID NO: 82449
  derived and/or modified sequence opt1 from neuraminidase__InfluenzaA__AEX35277

SEQ ID NO: 82559 - RNA, 1410 nt, Artificial Sequence
  derived and/or modified sequence opt1 from neuraminidase__InfluenzaA__AEX35288
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82560 - RNA, 1410 nt, Artificial Sequence; identical to SEQ ID NO: 75722
  derived and/or modified sequence opt1 from neuraminidase__InfluenzaA__AEX35299

SEQ ID NO: 82561 - RNA, 1410 nt, Artificial Sequence
  derived and/or modified sequence opt1 from neuraminidase__InfluenzaA__AEX35310
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacggggacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 82562 - RNA, 1410 nt, Artificial Sequence; identical to SEQ ID NO: 75722
  derived and/or modified sequence opt1 from neuraminidase__InfluenzaA__AEX35321

SEQ ID NO: 82563 - RNA, 1410 nt, Artificial Sequence; identical to SEQ ID NO: 76937
  derived and/or modified sequence opt1 from neuraminidase__InfluenzaA__AEX35332

SEQ ID NO: 82564 - RNA, 1410 nt, Artificial Sequence; identical to SEQ ID NO: 76937
  derived and/or modified sequence opt1 from neuraminidase__InfluenzaA__AEX35343

SEQ ID NO: 82565 - RNA, 1410 nt, Artificial Sequence
  derived and/or modified sequence opt1 from neuraminidase__InfluenzaA__AEX35354
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccaccagcggcaaggccgacacgaagauccucuucaucgaggagggcaagaucgugcacaccagcacccuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggcguucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 82566 - RNA, 1410 nt, Artificial Sequence; identical to SEQ ID NO: 75722
  derived and/or modified sequence opt1 from neuraminidase__InfluenzaA__AEX35365

SEQ ID NO: 82567 - RNA, 1410 nt, Artificial Sequence
  derived and/or modified sequence opt1 from neuraminidase__InfluenzaA__AEX35376
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgagcgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82568 - RNA, 1410 nt, Artificial Sequence; identical to SEQ ID NO: 75722
  derived and/or modified sequence opt1 from neuraminidase__InfluenzaA__AEX35387

SEQ ID NO: 82569 - RNA, 1410 nt, Artificial Sequence
  derived and/or modified sequence opt1 from neuraminidase__InfluenzaA__AEX35398
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 82570 - RNA, 1410 nt, Artificial Sequence; identical to SEQ ID NO: 75722
  derived and/or modified sequence opt1 from neuraminidase__InfluenzaA__AEX35409

SEQ ID NO: 82571 - RNA, 1410 nt, Artificial Sequence; identical to SEQ ID NO: 82559
  derived and/or modified sequence opt1 from neuraminidase__InfluenzaA__AEX35420

SEQ ID NO: 82572 - RNA, 1410 nt, Artificial Sequence
  derived and/or modified sequence opt1 from neuraminidase__InfluenzaA__AEX35431
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagaaggagaccgaggugcuguggaccuccaacagcaucgucguguucugcggcaccuccgggacguacggcaccgggagcuggccggacggcgccgacaucaaccugaugcccaucuga

SEQ ID NO: 82573 - RNA, 1410 nt, Artificial Sequence; identical to SEQ ID NO: 75720
  derived and/or modified sequence opt1 from neuraminidase__InfluenzaA__AEX35453

SEQ ID NO: 82574 - RNA, 1410 nt, Artificial Sequence; identical to SEQ ID NO: 75720
  derived and/or modified sequence opt1 from neuraminidase__InfluenzaA__AEX35464

SEQ ID NO: 82575 - RNA, 1410 nt, Artificial Sequence; identical to SEQ ID NO: 75720
  derived and/or modified sequence opt1 from neuraminidase__InfluenzaA__AEX35475

SEQ ID NO: 82576 - RNA, 1410 nt, Artificial Sequence; identical to SEQ ID NO: 75720
  derived and/or modified sequence opt1 from neuraminidase__InfluenzaA__AEX35486

SEQ ID NO: 82577 - RNA, 1410 nt, Artificial Sequence
  derived and/or modified sequence opt1 from neuraminidase__InfluenzaA__AEX35497
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82578 - RNA, 1410 nt, Artificial Sequence; identical to SEQ ID NO: 75720
  derived and/or modified sequence opt1 from neuraminidase__InfluenzaA__AEX35508

SEQ ID NO: 82579 - RNA, 1410 nt, Artificial Sequence; identical to SEQ ID NO: 82577
  derived and/or modified sequence opt1 from neuraminidase__InfluenzaA__AEX35519

SEQ ID NO: 82580 - RNA, 1410 nt, Artificial Sequence
  derived and/or modified sequence opt1 from neuraminidase__InfluenzaA__AEX35530
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcagugcgagcccacgaucaucgagcgcaacaucaccgagaucguguaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccagcuccugccacgacgggaaggccuggcugcacgugugcgugaccggcgacgacaagaacgcgaccgccagcuucaucuacaacgggcgccucguggacuccaucgucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuaccccggcguccggugcgugugccgcgacaacuggaaggggagcaaccggccgaucguggacaucaacaccaaggacuacuccaucgucagcuccuacgugugcagcggccuggugggcgacacgccccgcaagaacgacuccagcuccagcucccacugccugaaccccaacaacgaggagggcgggcacggggucaagggcugggccuucgacgacgggaacgacguguggaugggccggaccaucagcgagaagcuccgccugggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 82581 - RNA, 1410 nt, Artificial Sequence; identical to SEQ ID NO: 75720
  derived and/or modified sequence opt1 from neuraminidase__InfluenzaA__AEX35541

SEQ ID NO: 82582 - RNA, 1410 nt, Artificial Sequence
  derived and/or modified sequence opt1 from neuraminidase__InfluenzaA__AEX35552
augaaccccaaccagaagaucaucaccaucggcagcgccucccugaccaucagcacgaucugcuucuucaugcagaucgccauccucaucaccaccgugacccugcacuucaagcaguacgaguucaacccgccgcccaacaaccaggcgaugcugugcgagcccacgaucaucgagcgcaacaucaccgagaucgucuaccucaccaacaccacgaucgagaaggagaucugccccaagcuggccgaguaccggaacugguccaagccccagugcgacaucaccggguucgcccccuucagcaaggacaacuccauccgccugagcgccggcggggacaucugggugacccgggagcccuacguguccugcgacccggacaagugcuaccaguucgcccucggccaggggaccacgcugaacaacguccacagcaacgacaccgugcacgaccgcacccccuaccggacccugcucaugaacgagcugggcgugcccuuccaccugggcacgaagcaggucugcaucgcgugguccagcuccagcugccacgacgggaaggccuggcuccacgugugcgugaccggcgacgacaagaacgccaccgccuccuucaucuacaacgggcgccuggucgacagcaucguguccuggagcaaggagauccugcggacccaggaguccgagugcgugugcaucaacggcacgugcaccgucgugaugaccgacgggagcgcguccggcaaggccgacaccaagauccucuucaucgaggagggcaagaucgugcacacgagcacccugagcggguccgcccagcacgucgaggagugcagcugcuacccccgcuacccgggcgugcggugcgugugccgcgacaacuggaagggguccaaccggcccaucgucgacaucaacaucaaggacuacagcaucgccuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggugaucgaggggugguccaacccgaacagcaagcugcagaucaaccggcaggucaucguggaccgcggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggcccgacggcgcggacaucaaccugaugcccaucuga

SEQ ID NO: 82583 - RNA, 1410 nt, Artificial Sequence
  derived and/or modified sequence opt1 from neuraminidase__InfluenzaA__AEX35563
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucaaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 82584 - RNA, 1410 nt, Artificial Sequence; identical to SEQ ID NO: 82464
  derived and/or modified sequence opt1 from neuraminidase__InfluenzaA__AEX35585

SEQ ID NO: 82585 - RNA, 1410 nt, Artificial Sequence
  derived and/or modified sequence opt1 from neuraminidase__InfluenzaA__AEX35596
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccgacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82586 - RNA, 1410 nt, Artificial Sequence; identical to SEQ ID NO: 75720
  derived and/or modified sequence opt1 from neuraminidase__InfluenzaA__AEX35607

SEQ ID NO: 82587 - RNA, 1410 nt, Artificial Sequence
  derived and/or modified sequence opt1 from neuraminidase__InfluenzaA__AEX35618
augaaccccaaccagaagaucaucaccaucggcagcgugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaccugccccaagcuggccgaguaccggaacuggagcaagccgcagugcuacaucaccggguucgcgcccuucuccaaggacaacagcauccgccucuccgccggcggggacaucugggucacccgggagcccuacgugagcugcgaccccgacaagugcuaccaguucgcccugggccaggggacgacccugaacaacgugcacuccaacgacaccguccgcgaccggaccccguaccgcacgcuccugaugaacgagcugggcgugcccuuccaccucggcaccaagcaggucugcaucgccuggagcuccagcuccugccacgacgggaaggccuggcugcacgugugcaucaccggcgacgacaagaacgcgaccgccagcuucaucuacaacgggcggcugguggacuccaucgugagcugguccaaggagauccuccgcacgcaggagagcgagugcgucugcaucaacgggaccugcaccguggugaugaccgacggguccgccagcggcaaggccgacacgaagauccuguucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccucgugggcgacacgccccggaagaacgacuccagcuccagcucccacugccuggaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccgggacaaccgcagcggcuacuccgggaucuucagcguggagggcaagagcugcaucaaccggugcuucuacgucgagcugauccgcgggcggaaggaggagaccgaggugcuguggaccuccaacagcaucguggucuucugcggcacguccggcaccuacgggaccggcagcuggccggacggggccgacaucaaccucaugcccaucuga

SEQ ID NO: 82588 - RNA, 1410 nt, Artificial Sequence
  derived and/or modified sequence opt1 from neuraminidase__InfluenzaA__AEX35640
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacaacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacgacgaggagggcgggcacggcgucaaggggugggccuucgacgacggcaacgacguguggaugggccggaccaucuccgagaagucccgcagcggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 82589 - RNA, 1410 nt, Artificial Sequence
  derived and/or modified sequence opt1 from neuraminidase__InfluenzaA__AEX35651
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgaggacaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 82590 - RNA, 1410 nt, Artificial Sequence; identical to SEQ ID NO: 76892
  derived and/or modified sequence opt1 from neuraminidase__InfluenzaA__AEX36105

SEQ ID NO: 82591 - RNA, 1410 nt, Artificial Sequence
  derived and/or modified sequence opt1 from neuraminidase__InfluenzaA__AEX36116
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 82592 - RNA, 1410 nt, Artificial Sequence
  derived and/or modified sequence opt1 from neuraminidase__InfluenzaA__AEX36127
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggcugaagccgcagugcgacaucaccggguucgcgcccuucagcaaggacaacuccauccgccucagcgccggcggggacaucugggucacccgggagcccuacguguccugcgaccccgacaagugcuaccaguucgcccugggccaggggaccacgcugaacaacgugcacagcaacgacaccguccgcgaccggaccccguaccgcacccuccugaugaacgagcugggcgugcccuuccaccucggcacgaagcaggucugcaucgccugguccagcuccagcugccacgacgggaaggccuggcugcacgugugcaucaccggcgacgacaagaacgcgaccgccuccuucaucuacaacgggcggcugguggacagcguggucuccuggagcaaggagauccuccgcacccaggaguccgagugcgugugcaucaacggcacgugcaccguggucaugaccgacgggagcgccuccggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccucgugggcgacacgccccggaagaacgacagcuccagcuccagccacugccuggaccccaacaacgaggagggcgggcacggggucaagggcugggccuucgacgacggggacgacguguggaugggccgcaccaucuccgagaagucccggcugggcuacgagaccuucaaggucaucgagggguggagcaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 82593 - RNA, 1410 nt, Artificial Sequence
  derived and/or modified sequence opt1 from neuraminidase__InfluenzaA__AEX36149
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgaggacaagagcugcaucaaccggugcuucuacguggagcucauccgcgggcggaaggaggagaccgaggugcuguggaccaccaacuccaucgucguguucugcggcacgagcggcaccuacgggaccggcuccuggccggacggggccgacaucaaccugaugcccaucuga

SEQ ID NO: 82594 - RNA, 1410 nt, Artificial Sequence; identical to SEQ ID NO: 77520
  derived and/or modified sequence opt1 from neuraminidase__InfluenzaA__AEX36160

SEQ ID NO: 82595 - RNA, 1410 nt, Artificial Sequence
  derived and/or modified sequence opt1 from neuraminidase__InfluenzaA__AEX36171
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcgccguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacggggacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 82596 - RNA, 1410 nt, Artificial Sequence
  derived and/or modified sequence opt1 from neuraminidase__InfluenzaA__AEX36193
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggaugcugguggacagcaucguguccuggagcaaggagauccugcggacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgcuaccccggcgugcggugcgucugccgcgacaacuggaagggguccaaccggcccaucguggacaucaacaucaaggaccacagcaucguguccagcuacgucugcuccggccuggugggcgacaccccgcgcaagaacgacagcuccagcuccagccacugccucgaccccaacaacgaggagggcgggcacggggugaagggcugggccuucgacgacgggaacgacgucuggaugggccggaccaucuccgagaagucccgccugggcuacgagacguucaaggugaucgagggguggagcaaccccaagagcaagcugcagaucaaccggcaggucaucguggaccgcggcaaccgguccggguacagcggcaucuucagcguggaggggaaguccugcaucaaccgcugcuucuacgucgagcucauccggggccgcaaggaggagaccgaggugcuguggaccagcaacuccaucguggucuucugcggcaccagcgggacguacggcaccggguccuggcccgacggcgccgacaucaaccugaugccgaucuga

SEQ ID NO: 82597 - RNA, 1410 nt, Artificial Sequence
  derived and/or modified sequence opt1 from neuraminidase__InfluenzaA__AEX36204
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccgccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgagcgcaccccguaccggacccugcucaugaacgagcugggcgugcccuuccaccugggcaccaagcaggucugcaucgccuggagcuccagcuccugccacgacgggaaggcguggcuccacgugugcgugacgggcgacgacaagaacgccaccgccagcuucaucuacaacgggcgccugguggacuccaucgucagcugguccaaggagauccugcggacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgcuaccccggcguccggugcgugugccgcgacaacuggaaggggagcaaccggccgaucguggacaucaacaucaaggacuacuccaucgucagccgcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucuccgagaagucccggagcggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggaccuacggcacggggagcuggccggacggcgccgacaucaaccugaugcccaucuga

SEQ ID NO: 82598 - RNA, 1410 nt, Artificial Sequence
  derived and/or modified sequence opt1 from neuraminidase__InfluenzaA__AEX36215
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagaagaacaucacggagaucguguaccucaccaacaccaccaucgagaaggagaucugccccaagcuggcggaguaccgcaacugguccaagccgcagugcgacaucacgggguucgcccccuucagcaaggacaacuccauccggcugagcgccggcggggacaucugggucacccgcgagcccuacguguccugcgaccccgacaagugcuaccaguucgcccucggccaggggaccacccugaacaacgugcacagcaacgacacgguccacgagcggaccccguaccgcacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcggcugguggacagcaucgucuccuggagcaaggagauccugcgcacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgguaccccggcguccgcugcgugugccgggacaacuggaagggguccaaccgcccgaucguggacaucaacaucaaggacuacagcaucgucucccgguacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggaccuacggcacgggguccuggccggacggcgccgacaucaaccugaugcccaucuga

SEQ ID NO: 82599 - RNA, 1410 nt, Artificial Sequence
  derived and/or modified sequence opt1 from neuraminidase__InfluenzaA__AEX36226
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacaaccgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggcaucgugggcgacacgccccggaagaacgacuccagcuccagcucccacugccuggaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacagcaagcuccagaucaaccgccaggugaucguggaccggggcaaccgcuccggguacagcggcaucuucagcgucgaggggaaguccugcaucaaccggugcuucuacguggagcugauccgcggccggaaggaggagaccgaggugcuguggaccagcaacuccaucgucguguucugcggcaccagcgggaccuacggcacgggguccuggccggacggcgccgacaucaaccucaugcccaucuga

SEQ ID NO: 82600 - RNA, 1410 nt, Artificial Sequence
  derived and/or modified sequence opt1 from neuraminidase__InfluenzaA__AEX36237
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggagcaaccggccgaucguggacaucaacaugaaggacuacuccaucgucagcuccuacgugugcagcggccuggugggcgacacgccccgcaagaacgacuccagcuccagcgggcacugccucgaccccaacgacgaggagggcgggcacggcgucaaggggugggccuucgacgacggcaacgacguguggaugggccggaccaucuccgagaagucccgcagcggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 82601 - RNA, 1410 nt, Artificial Sequence
  derived and/or modified sequence opt1 from neuraminidase__InfluenzaA__AEX36248
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacaaccgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggccgcgcggacaccaagauccucuucaucgaggagggcaagaucgugcacaccuccacgcugagcggguccgcccagcacguggaggagugcagcugcuacccccgguaccccggcguccgcugcgugugccgggacaacuggaagggguccaaccgcccgaucguggacaucaacaucaaggacuacagcaucgucucccgguacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggaccuacggcacgggguccuggccggacggcgccgacaucaaccugaugcccaucuga

SEQ ID NO: 82602 - RNA, 1410 nt, Artificial Sequence; identical to SEQ ID NO: 77520
  derived and/or modified sequence opt1 from neuraminidase__InfluenzaA__AEX36259

SEQ ID NO: 82603 - RNA, 1410 nt, Artificial Sequence
  derived and/or modified sequence opt1 from neuraminidase__InfluenzaA__AEX36270
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccagcuccagcugccacgacggcaaggcguggcuccacgugugcgugacgggggacgacaagaacgccaccgccuccuucaucuacaacggccgccugguggacagcaucgucuccuggagcaaggagauccugcggacccaggaguccgagugcgugugcaucaacgggaccugcacgguggucaugaccgacggcagcgccagcggcaaggcggacaccaagauccucuucaucgaggaggggaagaucgugcacaccuccacgcugagcggcuccgcccagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggagcggguacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcggccgggaggaggagaccaaggugcucuggaccagcaacuccaucgucguguucugcgggaccagcggcaccuacgggacgggcuccuggccggacggggccgacaucaaccugaugcccaucuga

SEQ ID NO: 82604 - RNA, 1410 nt, Artificial Sequence
  derived and/or modified sequence opt1 from neuraminidase__InfluenzaA__AEX36281
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccagcuccagcugccacgacggcaaggcguggcuccacgugugcgugacgggggacgacaagaacgccaccgccuccuucaucuacaacggccgccugguggacagcaucgucuccuggagcaaggagauccugcggacccaggaguccgagugcgugugcaucaacgggaccugcacgguggucaugaccgacggcagcgccagcggcaaggcggacaccaagauccucuucaucgaggaggggaagaucgugcacaccuccacgcugagcggcuccgcccagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggagcggguacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcggccggaaggaggagaccgaggugcucuggaccagcaacuccaucgucguguucugcgggaccagcggcaccuacgggacgggcuccuggccggacggggccgacaucaaccugaugcccaucuga

SEQ ID NO: 82605 - RNA, 1410 nt, Artificial Sequence; identical to SEQ ID NO: 82604
  derived and/or modified sequence opt1 from neuraminidase__InfluenzaA__AEX36292

SEQ ID NO: 82606 - RNA, 1410 nt, Artificial Sequence
  derived and/or modified sequence opt1 from neuraminidase__InfluenzaA__AEX36303
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacgagcgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 82607 - RNA, 1410 nt, Artificial Sequence
  derived and/or modified sequence opt1 from neuraminidase__InfluenzaA__AEX36314
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcgccguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggggaccacggcgucaaggggugggccuucgacgacggcaacgacguguggauggggcgcaccaucagcgagaagucccggagcggcuacgagaccuucaaggucaucgagggcugguccaaccccaacagcaagcugcagaucaaccgccaggugaucguggaccgggggaaccgcuccggcuacagcgggaucuucagcgucgagggcaaguccugcaucaaccggugcuucuacguggagcugauccgcgggcggaaggaggagaccgaggugcucuggaccagcaacuccaucgucguguucugcggcaccagcggcaccuacgggacgggcuccuggccggacggggccgagaucaaccugaugcccaucuga

SEQ ID NO: 82608 - RNA, 1410 nt, Artificial Sequence; identical to SEQ ID NO: 82604
  derived and/or modified sequence opt1 from neuraminidase__InfluenzaA__AEX36336

SEQ ID NO: 82609 - RNA, 1410 nt, Artificial Sequence
  derived and/or modified sequence opt1 from neuraminidase__InfluenzaA__AEX36347
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccaucaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacaaccgcaccccguaccggacccugcucaugaacgagcugggcgugcccuuccaccugggcaccaagcaggucugcaucgccugguccagcuccagcugccacgacgggaaggccuggcuccacgugugcgugacgggcgacgacaagaacgcgaccgccuccuucaucuacaacgggcgccugguggacagcaucgucuccuggagcaaggagauccugcggacccaggaguccgagugcgugugcaucaacgggaccugcgccguggucaugacggacgggagcgccagcggcaaggcggacaccaagauccucuucaucgaggagggcaagaucgugcacgccuccacccugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcacgagcgggaccuacggcaccggguccuggccggacggcgccgacaucaaccugaugcccaucuga

SEQ ID NO: 82610 - RNA, 1410 nt, Artificial Sequence; identical to SEQ ID NO: 76892
  derived and/or modified sequence opt1 from neuraminidase__InfluenzaA__AEX36358

SEQ ID NO: 82611 - RNA, 1410 nt, Artificial Sequence
  derived and/or modified sequence opt1 from neuraminidase__InfluenzaA__AEX36369
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcaccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgacaucaaccugaugcccaucuga

SEQ ID NO: 82612 - RNA, 1410 nt, Artificial Sequence
  derived and/or modified sequence opt1 from neuraminidase__InfluenzaA__AEX36391
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucgcgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccgcaaccggaccccguaccgcacccugcucaugaacgagcugggcgugcccuuccaccugggcaccaagcaggucugcaucgccuggagcuccagcuccugccacgacgggaaggcguggcuccacgugugcaucacgggcgacgacaagaacgccaccgccagcuucaucuacaacgggcggcugguggacuccaucgugagcugguccaaggagauccugcgcacccaggagagcgagugcgucugcaucaacgggaccugcacgguggugaugaccgacggguccgccagcggcaaggcggacaccaagauccucuucaucgaggagggcaagaucguccacaccagcacgcuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcgaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggaccuacggcacggggagcuggccggacggcgccgacaucaaccugaugcccaucuga

SEQ ID NO: 82613 - RNA, 1410 nt, Artificial Sequence
  derived and/or modified sequence opt1 from neuraminidase__InfluenzaA__AEX36402
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguuccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcaccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgacaucaaccugaugcccaucuga

SEQ ID NO: 82614 - RNA, 1410 nt, Artificial Sequence; identical to SEQ ID NO: 76892
  derived and/or modified sequence opt1 from neuraminidase__InfluenzaA__AEX36413

SEQ ID NO: 82615 - RNA, 1410 nt, Artificial Sequence
  derived and/or modified sequence opt1 from neuraminidase__InfluenzaA__AEX36424
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugcagcaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccauccgcgaccggacccccuaccgcacccugcucaugaacgagcugggcgucccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcgugguguccuggagcaaggagauccugcgcacccaggaguccgagugcgucugcaucaacggcacgugcaccguggugaugaccgacgggagcgccagcggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacaccccgcggaagaacgacagcuccagcuccagccacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 82616 - RNA, 1410 nt, Artificial Sequence
  derived and/or modified sequence opt1 from neuraminidase__InfluenzaA__AEX36435
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaacuccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 82617 - RNA, 1410 nt, Artificial Sequence; identical to SEQ ID NO: 77074
  derived and/or modified sequence opt1 from neuraminidase__InfluenzaA__AEX36446

SEQ ID NO: 82618 - RNA, 1410 nt, Artificial Sequence; identical to SEQ ID NO: 77074
  derived and/or modified sequence opt1 from neuraminidase__InfluenzaA__AEX36457

SEQ ID NO: 82619 - RNA, 1410 nt, Artificial Sequence
  derived and/or modified sequence opt1 from neuraminidase__InfluenzaA__AEX36468
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacaaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcgggaacgcgcagcacguggaggagugcuccugcuacccccgcuaccccggcguccggugcgugugccgcgacaacuggaaggggagcaaccggccgaucguggacaucaacaucaaggacuacuccaucgucagccgcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggagcggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccaaggugcucuggaccuccaacagcaucgucguguucugcggcaccuccgggacguacggcaccgggagcuggccggacggcgccgacaucaaccugaugcccaucuga

SEQ ID NO: 82620 - RNA, 1410 nt, Artificial Sequence
  derived and/or modified sequence opt1 from neuraminidase__InfluenzaA__AEX36479
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccccaccaacaccacgaccgagaaggagaucugcccgaagcucgccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccugggccaggggacgacccucaacaacgugcacagcaacgacaccguccacgaccgcacccccuaccggacgcugcugaugaacgagcucggcgugcccuuccaccugggcaccaagcaggucugcaucgccugguccagcuccagcugccacgacgggaaggccuggcugcacgugugcgugaccggcgacgacaagaacgcgaccgccuccuucaucuacaacgggcgccucguggacagcaucgucuccuggagcaaggagauccugcggacgcaggaguccgagugcgugugcaucaacgggaccugcaccguggucaugaccgacgggagcgccagcggcaaggccgacacgaagauccuguucaucgaggagggcaagaucgugcacaccuccacccucagcggguccgcgcagcacguggaggagugcagcugcuacccccgcuacccgggcguccggugcgugugccgcgacaacuggaagggguccaaccggcccaucguggacaucaacaucaaggacuacagcaucgucucccgcuacgugugcagcggccuggugggcgacacgccccggaagaacgacuccagcuccagcucccacugccuggaccccaacaacgaggagggcggccacggggucaagggcugggccuucgacgacgggaacgacguguggaugggccgcaccaucagcgagaagcuccgguccggcuacgagaccuucaaggucaucgagggguggagcaacccgaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgccgacaucaaccugaugcccaucuga

SEQ ID NO: 82621 - RNA, 1410 nt, Artificial Sequence
  derived and/or modified sequence opt1 from neuraminidase__InfluenzaA__AEX36490
augaaccccaaccagaagaucaucaccaucggcagcgugucccugaccaucagcacgaucugcuucuucaugcagaucgccauccucaucaccaccgucacccugcacuucaagcaguacgaguucuccuacccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggaacgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccaaggugcucuggaccagcaacuccaucgucguguucugcggcaccagcgggacguacggcaccggguccuggccggacggcgccgacaucaaccugaugcccaucuga

SEQ ID NO: 82622 - RNA, 1410 nt, Artificial Sequence
  derived and/or modified sequence opt1 from neuraminidase__InfluenzaA__AEX36501
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaagugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacggccgcaccccguaccggacccugcucaugaacgagcugggcgugcccuuccaccuggggaccaagcaggucugcaucgccugguccagcuccagcugccacgacggcaaggcguggcuccacgugugcgugacgggggacgacaagaacgccaccgccuccuucaucuacaacggccgccugguggacagcaucgucuccuggagcaaggagauccugcggacccaggaguccgagugcgugugcaucaacgggaccugcacgguggucaugaccgacggcagcgccagcggcaaggcggacaccaagauccucuucaucgaggaggggaagaucgugcacaccuccacgcugagcggcuccgcccagcacguggaggagugcagcugcuacccccgcuaccccgggguccggugcgugugccgcgacaacuggaagggcuccaaccggccgaucguggacaucaacaucaaggacuacagcaucgucucccgcuacgugugcagcggccuggugggggacacgccccggaaguccgacagcuccagcuccagccacugccucgaccccaacaacgaggagggcgggcacggcgucaaggggugggccuucgacgacggcaacgacguguggaugggccgcaccaucuccgagaagucccggagcggguacgagaccuucaaggucaucgagggcuggagcaaccccaacuccaagcugcagaucaaccgccaggugaucguggaccgggggaaccgcagcggcuacagcgggaucuucuccgucgagggcaagagcugcaucaaccggugcuucuacguggagcugauccgcggccggaaggaggagaccgaggugcucuggaccuccaacagcaucgucguguucugcgggaccuccggcaccuacgggacgggcagcuggccggacggggccgacaucaaccugaugcccaucuga

SEQ ID NO: 82623 - RNA, 1410 nt, Artificial Sequence
  derived and/or modified sequence opt1 from neuraminidase__InfluenzaA__AEX36512
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccgccaucaucgagcgcaacaucacggagaucguguaccucaccaacaccaccaucgagaaggagaucugccccaagcuggcggaguaccggaacugguccaagccgcagugcgacaucacgggguucgcccccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccacgaccgcaccccguaccggacccugcucaugaacgagcugggcgugcccuuccaccugggcaccaagcaggucugcaucgccugguccagcuccagcugccacgacgggaaggcguggcuccacgugugcgugacgggcgacgacaagaacgccaccgccuccuucaucuacaacgggcgccugguggacagcaucgucuccuggagcaaggagauccugcggacccaggaguccgagugcgugugcaucaacgggaccugcacgguggucaugaccgacgggagcgccagcggcaaggcggacaccaagauccucuucaucgaggagggcaagaucgugcacaccuccacgcugagcggguccgcccagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggagcggcuacgagaccuucaaggucaucgaggggugguccaaccccaacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggaccuacggcacgggguccuggccggacggcgccgacaucaaccugaugcccaucuga

SEQ ID NO: 82624 - RNA, 1410 nt, Artificial Sequence
  derived and/or modified sequence opt1 from neuraminidase__InfluenzaA__AEX36523
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcgaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 82625 - RNA, 1410 nt, Artificial Sequence; identical to SEQ ID NO: 77607
  derived and/or modified sequence opt1 from neuraminidase__InfluenzaA__AEX36534

SEQ ID NO: 82626 - RNA, 1410 nt, Artificial Sequence
  derived and/or modified sequence opt1 from neuraminidase__InfluenzaA__AEX36545
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgcccucggcaaggccgacaccaagauccuguucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccucgugggcgacacgccccggaagaacgacagcuccagcuccagccacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 82627 - RNA, 1410 nt, Artificial Sequence; identical to SEQ ID NO: 77520
  derived and/or modified sequence opt1 from neuraminidase__InfluenzaA__AEX36556

SEQ ID NO: 82628 - RNA, 1410 nt, Artificial Sequence; identical to SEQ ID NO: 77520
  derived and/or modified sequence opt1 from neuraminidase__InfluenzaA__AEX36567

SEQ ID NO: 82629 - RNA, 1410 nt, Artificial Sequence
  derived and/or modified sequence opt1 from neuraminidase__InfluenzaA__AEX36578
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 82630 - RNA, 1410 nt, Artificial Sequence; identical to SEQ ID NO: 82629
  derived and/or modified sequence opt1 from neuraminidase__InfluenzaA__AEX36589

SEQ ID NO: 82631 - RNA, 1410 nt, Artificial Sequence
  derived and/or modified sequence opt1 from neuraminidase__InfluenzaA__AEX36600
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacaacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 82632 - RNA, 1410 nt, Artificial Sequence; identical to SEQ ID NO: 75722
  derived and/or modified sequence opt1 from neuraminidase__InfluenzaA__AEX36622

SEQ ID NO: 82633 - RNA, 1410 nt, Artificial Sequence
  derived and/or modified sequence opt1 from neuraminidase__InfluenzaA__AEX63619
augaaccccaaccagaagaucaucaccaucggcagcaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacguguccaacacgaacuucgucgccgagcaggcgguggccagcgugaagcuggccgggaacuccagccugugccccgucuccggcugggccaucuacagcaaggacaacuccgugcgcaucgggagcaagggcgacguguucgucauccgggagcccuucaucuccugcagccacuccgagugccgcaccuucuuccucacccagggcgcccugcugaacgacaagcacagcaacgggaccaucaaggaccggucccccuaccgcacgcucaugagcugcccgaucggcgaggugcccucccccuacaacagccgguucgagagcguggcgugguccgccagcgccugccacgacgggaccuccuggcugaccaucggcaucagcgggcccgacaacggcgccgucgcggugcugaaguacaacggcaucaucaccgacacgaucaaguccuggcgcaagaacauccuccggacccaggagagcgagugcgccugcgugaacggguccugcuucaccgucaugaccgacggcccgagcaacgggcaggccuccuacaagguguucaagaucgagcgcggcaagguggucaagagcguggagcugaacgcccccaacuaccacuacgaggagugcuccugcuaccccgagagcuccgagaucacgugcgugugccgggacaacuggcacggcagcaaccgccccugggucuccuucaaccagaaccuggaguaccagaugggguacaucugcagcggcaucuucggggacaacccgcggcccaacgacaagaccggcuccugcgggcccguguucagcaacggcgccaacggcgugaagggguucuccuucaaguacggcaacggggucuggaucggccgcaccaagagcaccagcucccggaugggguucgagaugaucugggaccccgacggcuggacgaagaccgacgacaaguucagcgugaagcaggacaucaucggcaucaccgacugguccggguacagcggcuccuucguccagcacccggagcucaccgggcuggacugcaugcgccccugcuucuggguggagcugauccggggccgccccaaggagaacacgaucuggaccagcggguccagcaucuccuucugcggcgugaacagcgacaccgucggcugguccuggcccgacggggcggagcucccguucaccaucgacaaguga

SEQ ID NO: 82634 - RNA, 1365 nt, Artificial Sequence; identical to SEQ ID NO: 76727
  derived and/or modified sequence opt1 from neuraminidase__InfluenzaA__AEX92876

SEQ ID NO: 82635 - RNA, 1365 nt, Artificial Sequence; identical to SEQ ID NO: 76727
  derived and/or modified sequence opt1 from neuraminidase__InfluenzaA__AEX92887

SEQ ID NO: 82636 - RNA, 1365 nt, Artificial Sequence; identical to SEQ ID NO: 76727
  derived and/or modified sequence opt1 from neuraminidase__InfluenzaA__AEX92904

SEQ ID NO: 82637 - RNA, 1365 nt, Artificial Sequence; identical to SEQ ID NO: 76727
  derived and/or modified sequence opt1 from neuraminidase__InfluenzaA__AEX96924

SEQ ID NO: 82638 - RNA, 1410 nt, Artificial Sequence; identical to SEQ ID NO: 79477
  derived and/or modified sequence opt1 from neuraminidase__InfluenzaA__AEY69091

SEQ ID NO: 82639 - RNA, 1410 nt, Artificial Sequence; identical to SEQ ID NO: 77607
  derived and/or modified sequence opt1 from neuraminidase__InfluenzaA__AEY69101

SEQ ID NO: 82640 - RNA, 1410 nt, Artificial Sequence; identical to SEQ ID NO: 77607
  derived and/or modified sequence opt1 from neuraminidase__InfluenzaA__AEY69112

SEQ ID NO: 82641 - RNA, 1410 nt, Artificial Sequence
  derived and/or modified sequence opt1 from neuraminidase__InfluenzaA__AEY69145
augaacaccaaccagaagaucaucaccaucggcagcgugucccugacgaucagcaccaucugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccccagugcgacaucaccggguucgcgccguucuccaaggacaacagcauccgccuguccgccggcggggacaucugggucacccgggagcccuacgugagcugcgaccccgacaagugcuaccaguucgcccucggccaggggacgaccaucaacaacgugcacuccaacaacaccguccgcgaccggacccccuaccgcacgcugcugaugaacgagcucggcgugccguuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcgcagcacguggaggagugcuccugcuacccccgguaccccggcguccgcugcgugugccgggacaacuggaaggggagcaaccgccccaucguggacaucaacaugaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcacgaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcgucgugguguucugcggcacguccgggaccuacggcaccgggagcuggcccgacggcgccgacaucaaccugaugccgaucuga

SEQ ID NO: 82642 - RNA, 1410 nt, Artificial Sequence; identical to SEQ ID NO: 77607
  derived and/or modified sequence opt1 from neuraminidase__InfluenzaA__AEY69156

SEQ ID NO: 82643 - RNA, 1410 nt, Artificial Sequence
  derived and/or modified sequence opt1 from neuraminidase__InfluenzaA__AEY69167
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 82644 - RNA, 1410 nt, Artificial Sequence; identical to SEQ ID NO: 82643
  derived and/or modified sequence opt1 from neuraminidase__InfluenzaA__AEY69178

SEQ ID NO: 82645 - RNA, 1410 nt, Artificial Sequence; identical to SEQ ID NO: 82643
  derived and/or modified sequence opt1 from neuraminidase__InfluenzaA__AEY69189

SEQ ID NO: 82646 - RNA, 1410 nt, Artificial Sequence
  derived and/or modified sequence opt1 from neuraminidase__InfluenzaA__AEY69211
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 82647 - RNA, 1410 nt, Artificial Sequence; identical to SEQ ID NO: 82643
  derived and/or modified sequence opt1 from neuraminidase__InfluenzaA__AEY69233

SEQ ID NO: 82648 - RNA, 1410 nt, Artificial Sequence; identical to SEQ ID NO: 82643
  derived and/or modified sequence opt1 from neuraminidase__InfluenzaA__AEY69272

SEQ ID NO: 82649 - RNA, 1410 nt, Artificial Sequence; identical to SEQ ID NO: 82643
  derived and/or modified sequence opt1 from neuraminidase__InfluenzaA__AEY69283

SEQ ID NO: 82650 - RNA, 1410 nt, Artificial Sequence
  derived and/or modified sequence opt1 from neuraminidase__InfluenzaA__AEY69294
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggcaacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 82651 - RNA, 1410 nt, Artificial Sequence; identical to SEQ ID NO: 82650
  derived and/or modified sequence opt1 from neuraminidase__InfluenzaA__AEY69305

SEQ ID NO: 82652 - RNA, 1410 nt, Artificial Sequence; identical to SEQ ID NO: 82650
  derived and/or modified sequence opt1 from neuraminidase__InfluenzaA__AEY69316

SEQ ID NO: 82653 - RNA, 1410 nt, Artificial Sequence; identical to SEQ ID NO: 82650
  derived and/or modified sequence opt1 from neuraminidase__InfluenzaA__AEY69788

SEQ ID NO: 82654 - RNA, 1410 nt, Artificial Sequence; identical to SEQ ID NO: 77607
  derived and/or modified sequence opt1 from neuraminidase__InfluenzaA__AEY69799

SEQ ID NO: 82655 - RNA, 1410 nt, Artificial Sequence; identical to SEQ ID NO: 77607
  derived and/or modified sequence opt1 from neuraminidase__InfluenzaA__AEY69810

SEQ ID NO: 82656 - RNA, 1410 nt, Artificial Sequence; identical to SEQ ID NO: 82643
  derived and/or modified sequence opt1 from neuraminidase__InfluenzaA__AEY69832

SEQ ID NO: 82657 - RNA, 1410 nt, Artificial Sequence
  derived and/or modified sequence opt1 from neuraminidase__InfluenzaA__AEY69843
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucgcgggcgacgacaagaacgccaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccguguga

SEQ ID NO: 82658 - RNA, 1410 nt, Artificial Sequence; identical to SEQ ID NO: 82643
  derived and/or modified sequence opt1 from neuraminidase__InfluenzaA__AEY69854

SEQ ID NO: 82659 - RNA, 1410 nt, Artificial Sequence; identical to SEQ ID NO: 82643
  derived and/or modified sequence opt1 from neuraminidase__InfluenzaA__AEY69876

SEQ ID NO: 82660 - RNA, 1410 nt, Artificial Sequence; identical to SEQ ID NO: 82643
  derived and/or modified sequence opt1 from neuraminidase__InfluenzaA__AEY69887

SEQ ID NO: 82661 - RNA, 1410 nt, Artificial Sequence; identical to SEQ ID NO: 82643
  derived and/or modified sequence opt1 from neuraminidase__InfluenzaA__AEY69898

SEQ ID NO: 82662 - RNA, 1410 nt, Artificial Sequence; identical to SEQ ID NO: 77607
  derived and/or modified sequence opt1 from neuraminidase__InfluenzaA__AEY69909

SEQ ID NO: 82663 - RNA, 1410 nt, Artificial Sequence
  derived and/or modified sequence opt1 from neuraminidase__InfluenzaA__AEY69942
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgacggcggggacaucugggucacccgggagcccuacgugagcugcgaccccgacaagugcuaccaguucgcccucggccaggggaccacgcugaacaacauccacuccaacaacaccgugcgcgaccggaccccguaccgcacccugcucaugaacgagcugggcguccccuuccaccugggcacgaagcaggucugcaucgccuggagcuccagcuccugccacgacgggaaggccuggcuccacgugugcaucaccggcgacgacaagaacgccaccgcgagcuucaucuacaacgggcggcugguggacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggcguucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccguguga

SEQ ID NO: 82664 - RNA, 1410 nt, Artificial Sequence; identical to SEQ ID NO: 82663
  derived and/or modified sequence opt1 from neuraminidase__InfluenzaA__AEY69953

SEQ ID NO: 82665 - RNA, 1410 nt, Artificial Sequence; identical to SEQ ID NO: 82663
  derived and/or modified sequence opt1 from neuraminidase__InfluenzaA__AEY69964

SEQ ID NO: 82666 - RNA, 1410 nt, Artificial Sequence; identical to SEQ ID NO: 82643
  derived and/or modified sequence opt1 from neuraminidase__InfluenzaA__AEY69975

SEQ ID NO: 82667 - RNA, 1410 nt, Artificial Sequence; identical to SEQ ID NO: 82643
  derived and/or modified sequence opt1 from neuraminidase__InfluenzaA__AEY69986

SEQ ID NO: 82668 - RNA, 1410 nt, Artificial Sequence; identical to SEQ ID NO: 82643
  derived and/or modified sequence opt1 from neuraminidase__InfluenzaA__AEY69997

SEQ ID NO: 82669 - RNA, 1410 nt, Artificial Sequence; identical to SEQ ID NO: 82643
  derived and/or modified sequence opt1 from neuraminidase__InfluenzaA__AEY70008

SEQ ID NO: 82670 - RNA, 1410 nt, Artificial Sequence; identical to SEQ ID NO: 82643
  derived and/or modified sequence opt1 from neuraminidase__InfluenzaA__AEY70019

SEQ ID NO: 82671 - RNA, 1410 nt, Artificial Sequence; identical to SEQ ID NO: 82643
  derived and/or modified sequence opt1 from neuraminidase__InfluenzaA__AEY70259

SEQ ID NO: 82672 - RNA, 1410 nt, Artificial Sequence; identical to SEQ ID NO: 82643
  derived and/or modified sequence opt1 from neuraminidase__InfluenzaA__AEY70270

SEQ ID NO: 82673 - RNA, 1410 nt, Artificial Sequence; identical to SEQ ID NO: 82643
  derived and/or modified sequence opt1 from neuraminidase__InfluenzaA__AEY70281

SEQ ID NO: 82674 - RNA, 1410 nt, Artificial Sequence; identical to SEQ ID NO: 77607
  derived and/or modified sequence opt1 from neuraminidase__InfluenzaA__AEY70303

SEQ ID NO: 82675 - RNA, 1410 nt, Artificial Sequence; identical to SEQ ID NO: 77607
  derived and/or modified sequence opt1 from neuraminidase__InfluenzaA__AEY70314

SEQ ID NO: 82676 - RNA, 1410 nt, Artificial Sequence
  derived and/or modified sequence opt1 from neuraminidase__InfluenzaA__AEY70325
augaaccccaaccagaagaucaucaccaucggcagcgugucccugaccaucagcacgaucugcuucuucaugcagaucgccauccucaugaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugcccgaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggcccgacggcgccgacaucaaccugaugcccguguga

SEQ ID NO: 82677 - RNA, 1410 nt, Artificial Sequence
  derived and/or modified sequence opt1 from neuraminidase__InfluenzaA__AEY70336
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcaucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggaggacaagagcugcaucaaccggugcuucuacgucgagcucauccgcgggcggaaggaggagaccgaggugcuguggaccuccaacagcaucguggucuucugcggcaccuccggcacguacgggaccggcagcuggccggacggggccgacaucaaccugaugcccguguga

SEQ ID NO: 82678 - RNA, 1410 nt, Artificial Sequence; identical to SEQ ID NO: 77746
  derived and/or modified sequence opt1 from neuraminidase__InfluenzaA__AEY70358

SEQ ID NO: 82679 - RNA, 1410 nt, Artificial Sequence; identical to SEQ ID NO: 77607
  derived and/or modified sequence opt1 from neuraminidase__InfluenzaA__AEY70379

SEQ ID NO: 82680 - RNA, 1410 nt, Artificial Sequence; identical to SEQ ID NO: 79369
  derived and/or modified sequence opt1 from neuraminidase__InfluenzaA__AFB70139

SEQ ID NO: 82681 - RNA, 1410 nt, Artificial Sequence; identical to SEQ ID NO: 77746
  derived and/or modified sequence opt1 from neuraminidase__InfluenzaA__AFB70141

SEQ ID NO: 82682 - RNA, 1410 nt, Artificial Sequence; identical to SEQ ID NO: 79369
  derived and/or modified sequence opt1 from neuraminidase__InfluenzaA__AFB70147

SEQ ID NO: 82683 - RNA, 1410 nt, Artificial Sequence; identical to SEQ ID NO: 77746
  derived and/or modified sequence opt1 from neuraminidase__InfluenzaA__AFB70153

SEQ ID NO: 82684 - RNA, 1410 nt, Artificial Sequence; identical to SEQ ID NO: 77746
  derived and/or modified sequence opt1 from neuraminidase__InfluenzaA__AFB70155

SEQ ID NO: 82685 - RNA, 1410 nt, Artificial Sequence; identical to SEQ ID NO: 78716
  derived and/or modified sequence opt1 from neuraminidase__InfluenzaA__AFB70157

SEQ ID NO: 82686 - RNA, 1410 nt, Artificial Sequence; identical to SEQ ID NO: 77746
  derived and/or modified sequence opt1 from neuraminidase__InfluenzaA__AFB70159

SEQ ID NO: 82687 - RNA, 1410 nt, Artificial Sequence
  derived and/or modified sequence opt1 from neuraminidase__InfluenzaA__AFB70161
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcacgaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguacuggcccgacggcgccgagcugccguucaccaucgacaaguga

SEQ ID NO: 82688 - RNA, 1410 nt, Artificial Sequence
  derived and/or modified sequence opt1 from neuraminidase__InfluenzaA__AFB70163
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacgccaucuggaccagcggguccagcaucuccuucugcggcgugaacagcgacaccgucgggugguccuggcccgacggcgcggagcugccguucaccaucgacaaguga

SEQ ID NO: 82689 - RNA, 1410 nt, Artificial Sequence
  derived and/or modified sequence opt1 from neuraminidase__InfluenzaA__AFB70169
augaaccccaaccagaagaucaucaccaucggcagcgugugcaugaccaucgggauggccaaccugauccuccagaucggcaacaucaucuccaucuggaucaaccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 82690 - RNA, 1410 nt, Artificial Sequence; identical to SEQ ID NO: 77746
  derived and/or modified sequence opt1 from neuraminidase__InfluenzaA__AFB70199

SEQ ID NO: 82691 - RNA, 1410 nt, Artificial Sequence; identical to SEQ ID NO: 77746
  derived and/or modified sequence opt1 from neuraminidase__InfluenzaA__AFB70209

SEQ ID NO: 82692 - RNA, 1410 nt, Artificial Sequence; identical to SEQ ID NO: 77746
  derived and/or modified sequence opt1 from neuraminidase__InfluenzaA__AFB70219

SEQ ID NO: 82693 - RNA, 1410 nt, Artificial Sequence; identical to SEQ ID NO: 77746
  derived and/or modified sequence opt1 from neuraminidase__InfluenzaA__AFB70229

SEQ ID NO: 82694 - RNA, 1410 nt, Artificial Sequence; identical to SEQ ID NO: 77746
  derived and/or modified sequence opt1 from neuraminidase__InfluenzaA__AFB70239

SEQ ID NO: 82695 - RNA, 1410 nt, Artificial Sequence; identical to SEQ ID NO: 77746
  derived and/or modified sequence opt1 from neuraminidase__InfluenzaA__AFB70249

SEQ ID NO: 82696 - RNA, 1410 nt, Artificial Sequence; identical to SEQ ID NO: 77746
  derived and/or modified sequence opt1 from neuraminidase__InfluenzaA__AFB70259

SEQ ID NO: 82697 - RNA, 1410 nt, Artificial Sequence; identical to SEQ ID NO: 78716
  derived and/or modified sequence opt1 from neuraminidase__InfluenzaA__AFB70269

SEQ ID NO: 82698 - RNA, 1410 nt, Artificial Sequence; identical to SEQ ID NO: 77746
  derived and/or modified sequence opt1 from neuraminidase__InfluenzaA__AFB70279

SEQ ID NO: 82699 - RNA, 1410 nt, Artificial Sequence; identical to SEQ ID NO: 77746
  derived and/or modified sequence opt1 from neuraminidase__InfluenzaA__AFB70289

SEQ ID NO: 82700 - RNA, 1410 nt, Artificial Sequence; identical to SEQ ID NO: 77746
  derived and/or modified sequence opt1 from neuraminidase__InfluenzaA__AFB70299

SEQ ID NO: 82701 - RNA, 1410 nt, Artificial Sequence; identical to SEQ ID NO: 77746
  derived and/or modified sequence opt1 from neuraminidase__InfluenzaA__AFB70309

SEQ ID NO: 82702 - RNA, 1410 nt, Artificial Sequence; identical to SEQ ID NO: 79369
  derived and/or modified sequence opt1 from neuraminidase__InfluenzaA__AFB70319

SEQ ID NO: 82703 - RNA, 1410 nt, Artificial Sequence; identical to SEQ ID NO: 77746
  derived and/or modified sequence opt1 from neuraminidase__InfluenzaA__AFB70329

SEQ ID NO: 82704 - RNA, 1410 nt, Artificial Sequence; identical to SEQ ID NO: 77746
  derived and/or modified sequence opt1 from neuraminidase__InfluenzaA__AFB70349

SEQ ID NO: 82705 - RNA, 1410 nt, Artificial Sequence; identical to SEQ ID NO: 77746
  derived and/or modified sequence opt1 from neuraminidase__InfluenzaA__AFB70359

SEQ ID NO: 82706 - RNA, 1410 nt, Artificial Sequence; identical to SEQ ID NO: 77746
  derived and/or modified sequence opt1 from neuraminidase__InfluenzaA__AFB70369

SEQ ID NO: 82707 - RNA, 1410 nt, Artificial Sequence; identical to SEQ ID NO: 77746
  derived and/or modified sequence opt1 from neuraminidase__InfluenzaA__AFB70379

SEQ ID NO: 82708 - RNA, 1410 nt, Artificial Sequence; identical to SEQ ID NO: 77746
  derived and/or modified sequence opt1 from neuraminidase__InfluenzaA__AFB70389

SEQ ID NO: 82709 - RNA, 1410 nt, Artificial Sequence; identical to SEQ ID NO: 77746
  derived and/or modified sequence opt1 from neuraminidase__InfluenzaA__AFB70399

SEQ ID NO: 82710 - RNA, 1410 nt, Artificial Sequence; identical to SEQ ID NO: 77746
  derived and/or modified sequence opt1 from neuraminidase__InfluenzaA__AFB70409

SEQ ID NO: 82711 - RNA, 1410 nt, Artificial Sequence
  derived and/or modified sequence opt1 from neuraminidase__InfluenzaA__AFB77614
augcaccccaaccaggaggugaucagcaucgucuccgugugcaugaccaucggcauggccaaccugauccuccagaucgggaacaucaucagcaucuggaucucccacagcauccagcugggcaaccagaaccagaucgagaccugcaaccaguccgugaucacguacgagaacaacaccugggucaaccagaccuacgugaacaucagcaacaccaacuucgccgcggggcaguccguggucagcgugaagcuggccggcaacuccagccucugcccgguguccgggugggccaucuacagcaaggacaacuccauccgcaucggcagcaagggcgacgucuucgugauccgggagcccuucaucuccugcagcccccuggagugccgcacguucuuccugacccagggggcccuccugaacgacaagcacuccaacggcaccaucaaggaccggagccccuaccgcacccugauguccugcccgaucggggaggugcccagccccuacaacagccgguucgaguccgucgccuggagcgcguccgccugccacgacggcaucaacuggcucacgaucgggaucagcggccccgacaacggcgccguggccgugcugaaguacaacgggaucaucaccgacaccaucaaguccuggcgcaacaacauccugcggacccaggagagcgagugcgcgugcgucaacggcuccugcuucacgaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggguccugcggccccgugagcuccaacggcgccaacggggucaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgugggcaucaacgaguggagcggguacuccggcagcuucguccagcacccggagcugaccgggcuggacugcauccgccccugcuucuggguggagcucauccggggccgccccaaggagaacacgaucuggaccuccggcagcuccaucagcuucugcggggucaacuccgacaccgugggcugguucuggcccgacggggccgagcugccguucaccaucgacaaguga

SEQ ID NO: 82712 - RNA, 1410 nt, Artificial Sequence
  derived and/or modified sequence opt1 from neuraminidase__InfluenzaA__AFB77615
augcaccccaaccaggagaucaucaccuucgugagcgucugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugagcgggugggccaucuacuccaaggacaacagcauccgcaucggcuccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaagggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 82713 - RNA, 1410 nt, Artificial Sequence
  derived and/or modified sequence opt1 from neuraminidase__InfluenzaA__AFB78128
augaaccccaaccagaagaucaucaccaucggcagcgugucccugaccaucgccacgaucugcuuccucaugcagaucgucauccuggugaccaccgugacccugcacuucaagcagcacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccagcuccagcugccacgacgggaaggccuggcugcacgugugcgugaccggccacgacgagaacgcgaccgccuccuucaucuacgacgggcggcuggucgacagcaucggcuccuggagcaagaagauccuccgcacccaggaguccgagugcgugugcaucaacgggacgugcaccguggucaugaccgacggcagcgccuccggccgggccgacaccaagauccuguucaucgaggaggggaagaucgugcacacgagcaagcugagcggcuccgcgcagcacguggaggagugcagcugcuacccccgcuaccccgggguccggugcgugugccgcgacaacuggaagggcuccaaccggccgaucguggacaucaacgucaaggacuacagcaucguguccagcuacgugugcuccggccucgucggggacacgccccgcaagaacgacagcuccagcuccagccacugccuggaccccaacaacgaggagggcgggcacggcgugaaggggugggccuucgacgacggcaacgacgucuggaugggccggaccaucuccgagaagucccgcagcggguacgagaccuucaaggugaucgagggcuggagcaagcccaacuccaagcugcagaucaaccgccaggugaucgucgagcgggggaacaugagcggcuacuccgggaucuucagcguggagggcaagagcugcaucaaccggugcuucuacguggagcucauccgcggccggaagcaggagaccgaggucugguggaccuccaacagcaucgugguguucugcgggaccuccggcaccuacgggacgggcagcuggccggacggggccgacaucaaccugaugcccaucuga

SEQ ID NO: 82714 - RNA, 1410 nt, Artificial Sequence
  derived and/or modified sequence opt1 from neuraminidase__InfluenzaA__AFC62078
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcuguucaucuccugcagcccccuggagugccgcaccuucuuccucacccagggcgcccugcugaacgacaagcacuccaacgggaccaucaaggaccggagccccuaccgcacgcucauguccugccccaucggcgaggucccgagccccuacaacagccgguucgaguccguggccuggagcgcguccgccugccacgacgggaucaacuggcugaccaucggcaucagcggccccgacaacggggccguggccguccugaaguacaacggcaucaucaccgacaccaucaaguccuggcgcaacgacauccuccggacgcaggagagcgagugcgcgugcgugaacggguccugcuucaccaucaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcaucuucggggacaacccccggccgaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcaccccgagcugacgggcauggacugcauccgcccgugcuucuggguggagcucauccggggccgccccaaggagaacaccaucuggaccuccgggagcuccaucagcuucugcggcgucaacuccgacaccgugggguggagcuggcccgacggcgccgagcugcccuucacgaucgacaaguga

SEQ ID NO: 82715 - RNA, 1410 nt, Artificial Sequence
  derived and/or modified sequence opt1 from neuraminidase__InfluenzaA__AFC62079
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcauccugggggacaacccgcggcccaacgacaagaccggcagcugcggccccgucuccagcaacggggccaacggcgugaagggguucuccuucaaguacggcaacggggugugggucggccgcaccaagagcaucagcucccggaacggcuucgagaugaucugggaccccaacggguggaccggcaccgacaacaacuucagcaucaagcaggacaucguggggaucaaggagugguccggcuacagcggguccuucgugcagcacccggagcugacgggccucgacugcauccgccccugcuucugggucgagcugauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 82716 - RNA, 1410 nt, Artificial Sequence
  derived and/or modified sequence opt1 from neuraminidase__InfluenzaA__AFC62080
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggcaugggcugcauccgccccugcuucuggguggagcugauccgggggcgccccaaggagaacaccaucuggaccuccggcagcuccaucagcuucugcggggucaacuccgacaccgugggcuggagcuggcccgacggcgccgagcucccguucacgaucgacaaguga

SEQ ID NO: 82717 - RNA, 1410 nt, Artificial Sequence
  derived and/or modified sequence opt1 from neuraminidase__InfluenzaA__AFC62082
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaugaaggaccacuccaucgucagcuccuacgugugcagcggccuggugggggacacgccccggaagaacgacuccagcuccagcucccacugcuucgaccccaacgacgaggagggcgggcacggcgucaaggggugggccuucgacgacggcaacgacguguggaugggccgcaccaucagcgagaagucccggcucggguacgagaccuucaaggucaucgagggcuggagcaaccccaaguccaagcugcagaucaaccgccaggugaucguggaccgcggggaccggagcggcuacuccgggaucuucagcgucgagggcaagagcugcaucaaccggugcuucuacguggagcugauccgcggcuccaaggaggagaccgaggugcucuggaccagcaacuccaucgucguguucugcgggaccagcggcacguacgggaccggcuccuggccggacggggccgacaucaaccugaugcccaucuga

SEQ ID NO: 82718 - RNA, 1410 nt, Artificial Sequence; identical to SEQ ID NO: 75233
  derived and/or modified sequence opt1 from neuraminidase__InfluenzaA__AFD63529

SEQ ID NO: 82719 - RNA, 1410 nt, Artificial Sequence; identical to SEQ ID NO: 75233
  derived and/or modified sequence opt1 from neuraminidase__InfluenzaA__AFD63540

SEQ ID NO: 82720 - RNA, 1410 nt, Artificial Sequence
  derived and/or modified sequence opt1 from neuraminidase__InfluenzaA__AFD63551
augaaccccaaccagaagaucaucaccaucggcagcgugucccugaccaucgccgccaucugcuuccucaugcagaucgcgauccuggucacgaccgugacccugcacuucaagcagcacgagugcaacccgccgcccaacaaccaggugaugcucugcgagcccaccaucaucgagcgcaacaucacggagaucgucuaccugaccaacaccaccaucgagaaggagaucugccccaagcuggccgaguaccggaacuggagcaagccccagugcaacaucacgggguucgcccccuucuccaaggacaacagcauccgccucuccgccggcggggacaucugggugacccgggagcccuacgugagcugcgacccggacaagugcuaccaguucgcccugggccaggggaccacccugaacaacggccacuccaacgacacgguccacggccgcacccccuaccggacccuccugaugaacgagcugggggugcccuuccaccucggcacccgccaggugugcaucgcguggagcuccagcuccugccacgacgggaaggccuggcugcacgucugcgugacgggcgacgacaagaacgccaccgccagcuucaucuacaacgggcggcugguggacuccaucggcagcugguccaagaagauccuccgcacccaggagagcgagugcgucugcaucaacgggaccugcacgguggugaugaccgacggguccgcgagcggcaaggccgacaccaagauccuguucaucgaggaggggaagaucguccacaucuccacccugagcggcagcgcccagcacguggaggagugcuccugcuacccccgguacccgggcgugcgcugcgucugccgggacaacuggaaggggagcaaccgccccaucguggacaucaacgugaaggacuacuccaucgucagcuccuacgugugcagcggccucgugggggacacgccccggaagaacgacuccuucagcuccagccacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagccgaacagcaagcuccagaucaaccgccaggugaucguggagcgggggaaccgcuccggcuacagcggcaucuucuccgucgagggcaagagcugcaucaaccggugcuucuacguggagcugauccgcggccggaaggaggagaccgaggugugguggacguccaacagcaucgucguguucugcgggaccagcggcaccuacgggaccggcuccuggcccgacggcgccgacaucaaccugaugcccaucuga

SEQ ID NO: 82721 - RNA, 1410 nt, Artificial Sequence; identical to SEQ ID NO: 75233
  derived and/or modified sequence opt1 from neuraminidase__InfluenzaA__AFD63562

SEQ ID NO: 82722 - RNA, 1410 nt, Artificial Sequence
  derived and/or modified sequence opt1 from neuraminidase__InfluenzaA__AFD63573
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgggcgcaacaucaccgagaucgucuaccugaccaacaccacgaucgagaaggagaucugccccaagcuggcggaguaccggaacugguccaagccgcagugcaacaucaccggcuucgcccccuucagcaaggacaacuccauccgccucagcgccgggggcgacaucugggugacccgggagcccuacguguccugcgaccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacaagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucguccacaucagcacgcugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggaccagcaacagcaucgucguguucugcgggaccuccggcaccuacgggacgggcagcuggccggacggcgccgacaucaaccugaugcccaucuga

SEQ ID NO: 82723 - RNA, 1410 nt, Artificial Sequence
  derived and/or modified sequence opt1 from neuraminidase__InfluenzaA__AFD63584
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucauccacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccagcaacuccaucguggucuucugcggcaccagcgggaccuacggcacgggguccuggccggacggcgccgacaucaaccugaugcccaucuga

SEQ ID NO: 82724 - RNA, 1410 nt, Artificial Sequence
  derived and/or modified sequence opt1 from neuraminidase__InfluenzaA__AFD63595
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugcaaggacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 82725 - RNA, 1410 nt, Artificial Sequence; identical to SEQ ID NO: 75233
  derived and/or modified sequence opt1 from neuraminidase__InfluenzaA__AFD63606

SEQ ID NO: 82726 - RNA, 1410 nt, Artificial Sequence; identical to SEQ ID NO: 75153
  derived and/or modified sequence opt1 from neuraminidase__InfluenzaA__AFD63628

SEQ ID NO: 82727 - RNA, 1410 nt, Artificial Sequence; identical to SEQ ID NO: 75233
  derived and/or modified sequence opt1 from neuraminidase__InfluenzaA__AFD63639

SEQ ID NO: 82728 - RNA, 1410 nt, Artificial Sequence; identical to SEQ ID NO: 75233
  derived and/or modified sequence opt1 from neuraminidase__InfluenzaA__AFD63650

SEQ ID NO: 82729 - RNA, 1410 nt, Artificial Sequence
  derived and/or modified sequence opt1 from neuraminidase__InfluenzaA__AFD63661
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacuccaccaucgagaaggagaucugccccaagcuggccgaguaccggaacuggagcaagccgcagugcaacaucaccggguucgcccccuucuccaaggacaacagcauccgccucuccgccggcggggacaucugggugacgcgggagcccuacgugagcugcgaccccgacaagugcuaccaguucgcccugggccaggggaccacccugaacaacggccacuccaacgacaccguccacgaccgcacgccguaccggacccuccugaugaacgagcugggcgugcccuuccaccucgggacccgccaggugugcaucgcguggagcuccagcuccugccacgacggcaaggccuggcugcacgucugcgugaccggggacgacaagaacgccacggccagcuucaucuacaacggccggcugguggacuccaucgggagcugguccaagaagauccuccgcacccaggagagcgagugcgucugcaucaacgggaccugcaccguggugaugacggacggcuccgcgagcgggaaggccgacaccaagauccuguucaucgaggagggcaagaucguccacaucagcacccuguccgggagcgcccagcacguggaggagugcuccugcuacccccgguaccccggcgugcgcugcgucugccgggacaacuggaagggcagcaaccgcccgaucguggacaucaacgugaaggacuacuccaucgucagcuccuacgugugcagcgggcucgugggcgacacgccccggaagaacgacuccuucagcuccagccacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagcccaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccagcaacuccaucgucguguucugcggcacgagcgggaccuacggcaccggguccuggccggacggcgccgacaucaaccugaugcccaucuga

SEQ ID NO: 82730 - RNA, 1410 nt, Artificial Sequence; identical to SEQ ID NO: 76939
  derived and/or modified sequence opt1 from neuraminidase__InfluenzaA__AFD63672

SEQ ID NO: 82731 - RNA, 1410 nt, Artificial Sequence
  derived and/or modified sequence opt1 from neuraminidase__InfluenzaA__AFD63683
augaaccccaaccagaagaucaucaccaugggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgcgccaggugugcaucgccugguccagcuccagcugccacgacgggaaggcguggcugcacgucugcgugaccggcgacgacaagaacgccaccgccuccuucaucuacaacgggcggcugguggacagcaucggcuccuggagcaagaagauccuccgcacccaggaguccgagugcgucugcaucaacggcacgugcaccguggugaugaccgacgggagcgccuccggcaaggcggacaccaagauccuguucaucgaggaggggaagaucauccacaucagcacgcugagcggcuccgcccagcacgucgaggagugcagcugcuacccccgguaccccggcgugcgcugcgugugccgggacaacuggaagggguccaaccgcccgaucgucgacaucaacgugaaggacuacagcaucguguccagcuacgucugcuccggccucgugggggacacgccccggaagaacgacagcuccagcuccagccacugccuggaccccaacaacgaggagggcgggcacggcgugaagggcugggccuucgacgacgggaacgacgucuggaugggccgcaccaucuccgagaagcugcggagcggguacgagaccuucaaggugaucgagggcugguccaagcccaacagcaagcuccagaucaaccgccaggucaucguggagcgggggaaccgcuccggcuacagcggcaucuucuccguggagggcaagagcugcaucaaccggugcuucuacgucgagcugauccgcgggcggaaggaggagaccgaggugugguggaccagcaacuccaucguggucuucugcgggaccagcggcaccuacgggacgggcuccuggccggacggcgccgacaucaaccugaugcccaucuga

SEQ ID NO: 82732 - RNA, 1410 nt, Artificial Sequence
  derived and/or modified sequence opt1 from neuraminidase__InfluenzaA__AFD63694
augaaccccaaccagaagaucaucaccaucggcagcgugucccugaccaucgccacgaucugcuuccucaugcagaucgccauccuggucaccaccaucacccugcacuucaagcagcacgagugcaacagcccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgccugguccagcuccagcugccacgacggcaaggcguggcugcacgugugcgucaccggggacgacaagaacgccaccgccuccuucaucuacaacggccggcugguggacagcaucggguccuggagcaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuucuccagcucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggucaucguggagcggggcaaccgcagcggguacuccggcaucuucagcguggagggcaaguccugcaucaaccggugcuucuacgucgagcugauccgcgggcggaaggaggagaccgaggugugguggaccagcaacagcaucguggucuucugcggcaccuccgggaccuacggcacggggagcuggccggacggcgccgacaucaaccugaugcccaucuga

SEQ ID NO: 82733 - RNA, 1410 nt, Artificial Sequence
  derived and/or modified sequence opt1 from neuraminidase__InfluenzaA__AFD63705
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggcaaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 82734 - RNA, 1410 nt, Artificial Sequence
  derived and/or modified sequence opt1 from neuraminidase__InfluenzaA__AFD63716
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugccaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 82735 - RNA, 1410 nt, Artificial Sequence; identical to SEQ ID NO: 75233
  derived and/or modified sequence opt1 from neuraminidase__InfluenzaA__AFD63727

SEQ ID NO: 82736 - RNA, 1410 nt, Artificial Sequence; identical to SEQ ID NO: 75233
  derived and/or modified sequence opt1 from neuraminidase__InfluenzaA__AFD63738

SEQ ID NO: 82737 - RNA, 1410 nt, Artificial Sequence
  derived and/or modified sequence opt1 from neuraminidase__InfluenzaA__AFD63749
augaaccccaaccagaagaucaucaccaucagcuccgugagccugaccaucgccacgaucugcuuccucaugcagaucgccauccuggucaccaccgugacccugcacuucaagcagcacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggcuucgcccccuucuccaaggacaacagcauccgccucuccgccgggggcgacaucugggugacccgggagcccuacgugagcugcgaccccgacaagugcuaccaguucgcccuggggcagggcaccacgcugaacaacgggcacuccaacgacaccguccacgaccgcaccccguaccggacccuccugaugaacgagcugggcgugcccuuccaccucggcacgcgccaggugugcaucgccuggagcuccagcuccugccacgacgggaaggcguggcugcacgucugcgugaccggcgacgacaagaacgccaccgccagcuucaucuacaacgggcggcugguggacuccaucggcagcugguccaagaagauccuccgcacccaggagagcgagugcgucugcaucaacgggacgugcaccguggugaugaccgacggcuccgccagcggcaaggcggacaccaagauccuguucaucgaggaggggaagaucguccacaucagcacgcuguccggcagcgcccagcacguggaggagugcuccugcuacccccgguaccccggggugcgcugcgucugccgggacaacuggaagggcagcaaccgcccgaucguggacaucaacgugaaggacuacuccaucgucagcuccuacgugugcagcggccucgugggggacacgccccggaagaacgacuccuucagcuccagccacugccuggaccccaacaacgaggagggcgggcacggcgucaaggggugggccuucgacgacggcaacgacguguggaugggccgcaccaucuccgagaagcugcggagcggguacgagaccuucaaggucaucgagggcugguccaagcccaacagcaagcuccagaucaaccgccaggugaucguggagcgggggaaccgcuccggcuacagcgggaucuucuccgucgagggcaagagcugcaucaaccggugcuucuacguggagcugauccgcggccggaaggaggagaccgaggugugguggaccagcaacuccaucgucguguucugcgggaccagcggcaccuacgggacgggcuccuggccggacggggccgacaucaaccugaugcccaucuga

SEQ ID NO: 82738 - RNA, 1410 nt, Artificial Sequence
  derived and/or modified sequence opt1 from neuraminidase__InfluenzaA__AFD63760
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucauccacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccagcaacuccaucguggucuucugcggcaccagcgggaccuacggcacgggguccuggccggacggcgccgacaucaaccugaugcccaucuga

SEQ ID NO: 82739 - RNA, 1410 nt, Artificial Sequence; identical to SEQ ID NO: 75233
  derived and/or modified sequence opt1 from neuraminidase__InfluenzaA__AFD63771

SEQ ID NO: 82740 - RNA, 1410 nt, Artificial Sequence; identical to SEQ ID NO: 75233
  derived and/or modified sequence opt1 from neuraminidase__InfluenzaA__AFD63782

SEQ ID NO: 82741 - RNA, 1410 nt, Artificial Sequence; identical to SEQ ID NO: 82738
  derived and/or modified sequence opt1 from neuraminidase__InfluenzaA__AFD63793

SEQ ID NO: 82742 - RNA, 1410 nt, Artificial Sequence; identical to SEQ ID NO: 75233
  derived and/or modified sequence opt1 from neuraminidase__InfluenzaA__AFD63804

SEQ ID NO: 82743 - RNA, 1410 nt, Artificial Sequence; identical to SEQ ID NO: 75233
  derived and/or modified sequence opt1 from neuraminidase__InfluenzaA__AFD63815

SEQ ID NO: 82744 - RNA, 1410 nt, Artificial Sequence; identical to SEQ ID NO: 75233
  derived and/or modified sequence opt1 from neuraminidase__InfluenzaA__AFD63826

SEQ ID NO: 82745 - RNA, 1410 nt, Artificial Sequence; identical to SEQ ID NO: 82738
  derived and/or modified sequence opt1 from neuraminidase__InfluenzaA__AFD63837

SEQ ID NO: 82746 - RNA, 1410 nt, Artificial Sequence
  derived and/or modified sequence opt1 from neuraminidase__InfluenzaA__AFD63848
augaaccccaaccagaagaucaucaccaucggcagcgugucccugaccaucgccgccaucugcuuccucaugcagaucgcgauccuggucacgaccgugacccugcacuucaagcagcgcgagugcaacagcccgcccaacaaccaggugaugcucugcgagcccaccaucaucgagcggaacaucacggagaucgucuaccugaccaacaccaccaucgagaaggagaucugccccaagcuggccgaguaccgcaacugguccaagccgcagugcaacaucacgggguucgcccccuucagcaaggacaacuccauccggcucagcgccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccggacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggagaagaccgaggugugguggacgagcaacagcaucgucguguucugcggcaccuccgggaccuacggcaccgggagcuggccggacggcgccgacaucaaccugaugcccaucuga

SEQ ID NO: 82747 - RNA, 1410 nt, Artificial Sequence; identical to SEQ ID NO: 75153
  derived and/or modified sequence opt1 from neuraminidase__InfluenzaA__AFD63859

SEQ ID NO: 82748 - RNA, 1410 nt, Artificial Sequence; identical to SEQ ID NO: 75153
  derived and/or modified sequence opt1 from neuraminidase__InfluenzaA__AFD63870

SEQ ID NO: 82749 - RNA, 1410 nt, Artificial Sequence; identical to SEQ ID NO: 75233
  derived and/or modified sequence opt1 from neuraminidase__InfluenzaA__AFD63881

SEQ ID NO: 82750 - RNA, 1410 nt, Artificial Sequence; identical to SEQ ID NO: 75233
  derived and/or modified sequence opt1 from neuraminidase__InfluenzaA__AFD63892

SEQ ID NO: 82751 - RNA, 1410 nt, Artificial Sequence
  derived and/or modified sequence opt1 from neuraminidase__InfluenzaA__AFD63903
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggggaucgucuaccugaccaacaccaccaucgagaaggagaucugccccaagcuggccgaguaccggaacugguccaagccgcagugcaacaucacgggcuucgcccccuucagcaaggacaacuccauccgccucagcgccgggggcgacaucugggugacccgggagcccuacguguccugcgaccccgacaagugcuaccaguucgcccuggggcagggcaccacccugaacaacggccacagcaacgacacgguccacgaccgcaccccguaccggacccuccugaugaacgagcugggggugcccuuccaccucggcacccgccaggugugcaucgcgugguccagcuccagcugccacgacgggaaggccuggcugcacgucugcgugacgggcgacgacaagaacgccaccgccuccuucaucuacaacgggcggcugguggacagcaucggcuccuggagcaagaagauccuccgcacccaggaguccgagugcgucugcaucaacgggaccugcacgguggugaugaccgacggcagcgcguccggcaaggccgacaccaagauccuguucaucgaggaggggaagaucguccacaucagcacccugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggacgagcaacagcaucgucguguucugcgggaccuccggcaccuacgggaccggcagcuggccggacggcgccgacaucaaccugaugcccaucuga

SEQ ID NO: 82752 - RNA, 1410 nt, Artificial Sequence
  derived and/or modified sequence opt1 from neuraminidase__InfluenzaA__AFD63914
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggagaagaccgaggugugguggacgagcaacagcaucgucguguucugcggcaccuccgggaccuacggcaccgggagcuggccggacggcgccgacaucaaccugaugcccaucuga

SEQ ID NO: 82753 - RNA, 1410 nt, Artificial Sequence; identical to SEQ ID NO: 82738
  derived and/or modified sequence opt1 from neuraminidase__InfluenzaA__AFD63925

SEQ ID NO: 82754 - RNA, 1410 nt, Artificial Sequence
  derived and/or modified sequence opt1 from neuraminidase__InfluenzaA__AFD63936
augaaccccaaccagaagaucaucaccaucggcagcgugucccugaccaucgccacgaucugcuuccucaugcagaucgccauccuggucaccaccgugacccugcacuucaagcagcacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggagcuccagcuccugccacgacggcaaggcguggcugcacgucugcgugaccggggacgacaagaacgccaccgccagcuucaucuacaacggccggcugguggacuccaucgggagcugguccaagaagauccuccgcacccaggagagcgagugcgucugcaucaacggcacgugcaccguggugaugaccgacggcuccgccagcgggaaggcggacaccaagauccuguucaucgaggagggcaagaucguccacaucuccacgcugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccuucagcuccagccacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcuccagaucaaccgccaggugaucguggagcggggcaaccgcuccggguacagcggcaucuucuccgucgagggcaagagcugcaucaaccggugcuucuacguggagcugauccgcgggcggaaggaggagaccgaggugugguggaccuccaacagcaucgucguguucugcggcaccagcgggaccuacggcacgggguccuggcccgacggcgccgacaucaaccugaugcccaucuga

SEQ ID NO: 82755 - RNA, 1410 nt, Artificial Sequence; identical to SEQ ID NO: 75233
  derived and/or modified sequence opt1 from neuraminidase__InfluenzaA__AFD63947

SEQ ID NO: 82756 - RNA, 1410 nt, Artificial Sequence; identical to SEQ ID NO: 75233
  derived and/or modified sequence opt1 from neuraminidase__InfluenzaA__AFD63958

SEQ ID NO: 82757 - RNA, 1410 nt, Artificial Sequence; identical to SEQ ID NO: 75233
  derived and/or modified sequence opt1 from neuraminidase__InfluenzaA__AFD63969

SEQ ID NO: 82758 - RNA, 1410 nt, Artificial Sequence; identical to SEQ ID NO: 75233
  derived and/or modified sequence opt1 from neuraminidase__InfluenzaA__AFD63980

SEQ ID NO: 82759 - RNA, 1410 nt, Artificial Sequence
  derived and/or modified sequence opt1 from neuraminidase__InfluenzaA__AFD64002
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaccgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagacggaggugugguggaccagcaacagcaucgucguguucugcggcaccuccgggaccuacggcacggggagcuggccggacggcgccgacaucaaccugaugcccaucuga

SEQ ID NO: 82760 - RNA, 1410 nt, Artificial Sequence; identical to SEQ ID NO: 75143
  derived and/or modified sequence opt1 from neuraminidase__InfluenzaA__AFD64013

SEQ ID NO: 82761 - RNA, 1410 nt, Artificial Sequence
  derived and/or modified sequence opt1 from neuraminidase__InfluenzaA__AFD64024
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagaagaacaucacggagaucgucuaccugaccaacaccaccaucgagaaggagaucugccccaagcuggccgaguaccgcaacugguccaagccgcagugcaacaucacgggguucgcccccuucagcaaggacaacuccauccggcucagcgccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccggacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggacgagcaacagcaucgucguguucugcggcaccuccgggaccuacggcaccgggagcuggccggacggcgccgacaucaaccugaugcccaucuga

SEQ ID NO: 82762 - RNA, 1410 nt, Artificial Sequence
  derived and/or modified sequence opt1 from neuraminidase__InfluenzaA__AFD64035
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcgucgugguguucugcggcaccuccgggaccuacggcaccgggagcuggccggacggcgccgacaucaaccugaugcccaucuga

SEQ ID NO: 82763 - RNA, 1410 nt, Artificial Sequence
  derived and/or modified sequence opt1 from neuraminidase__InfluenzaA__AFD64046
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 82764 - RNA, 1410 nt, Artificial Sequence; identical to SEQ ID NO: 82738
  derived and/or modified sequence opt1 from neuraminidase__InfluenzaA__AFD64057

SEQ ID NO: 82765 - RNA, 1410 nt, Artificial Sequence
  derived and/or modified sequence opt1 from neuraminidase__InfluenzaA__AFD64068
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagucccgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 82766 - RNA, 1410 nt, Artificial Sequence
  derived and/or modified sequence opt1 from neuraminidase__InfluenzaA__AFD64079
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgcaucagcgccggcggggacaucugggugacccgggagcccuacguguccugcgaccccgacaagugcuaccaguucgcccucggccaggggaccacccugaacaacggccacagcaacgacacgguccacgaccgcaccccguaccggacccugcucaugaacgagcugggcgugcccuuccaccuggggacccgccaggugugcaucgcgugguccagcuccagcugccacgacggcaaggccuggcuccacgucugcgugacgggggacgacaagaacgccaccgccuccuucaucuacaacggccggcugguggacagcaucggguccuggagcaagaagauccugcgcacccaggaguccgagugcgucugcaucaacgggaccugcacgguggugaugaccgacggcagcgcguccgggaaggccgacaccaagauccucuucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcuggugggcgacacgccccggaagaacgacagcuucuccagcucccacugccucgaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcugcagaucaaccgccaggugaucguggagcggggcaaccgcagcggguacuccggcaucuucagcgucgagggcaaguccugcaucaaccggugcuucuacguggagcucauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 82767 - RNA, 1410 nt, Artificial Sequence; identical to SEQ ID NO: 75233
  derived and/or modified sequence opt1 from neuraminidase__InfluenzaA__AFD64090

SEQ ID NO: 82768 - RNA, 1410 nt, Artificial Sequence
  derived and/or modified sequence opt1 from neuraminidase__InfluenzaA__AFD64101
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacggccgcaccccguaccggacccuccugaugaacgagcugggggugcccuuccaccucggcacccgccaggugugcaucgcgugguccagcuccagcugccacgacgggaaggccuggcugcacgucugcgugacgggcgacgacaagaacgccaccgccuccuucaucuacaacgggcggcugguggacagcaucggcuccuggagcaagaagauccuccgcacccaggaguccgagugcgucugcaucaacgggaccugcacgguggugaugaccgacggcagcgcguccggcaaggccgacaccaagauccuguucaucgaggaggggaagaucguccacaucagcacccugagcggcuccgcccagcacguggaggagugcagcugcuacccccgguaccccggcgugcgcugcgucugccgggacaacuggaagggguccaaccgcccgaucguggacaucaacgugaaggacuacagcaucgucuccagcuacgugugcuccggccucgugggggacacgccccggaagaacgacagcuucuccagcucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggagcaagcccaacuccaagcuccagaucaaccgccaggugaucguggagcgggggaaccgcagcggcuacuccggcaucuucagcgucgaggggaaguccugcaucaaccggugcuucuacguggagcugauccgcggccggaaggaggagaccgaggugugguggacgagcaacagcaucgucguguucugcgggaccuccggcaccuacgggaccggcagcuggccggacggcgccgacaucaaccugaugcccaucuga

SEQ ID NO: 82769 - RNA, 1410 nt, Artificial Sequence
  derived and/or modified sequence opt1 from neuraminidase__InfluenzaA__AFD64112
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucauccacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcgggacaaccgcuccggcuacagcgggaucuucuccguggagggcaagagcugcaucaaccggugcuucuacgucgagcugauccgcggccggaaggaggagaccgaggugugguggaccagcaacuccaucguggucuucugcgggaccagcggcaccuacgggacgggcuccuggccggacggggccgacaucaaccugaugcccaucuga

SEQ ID NO: 82770 - RNA, 1410 nt, Artificial Sequence; identical to SEQ ID NO: 76939
  derived and/or modified sequence opt1 from neuraminidase__InfluenzaA__AFD64123

SEQ ID NO: 82771 - RNA, 1410 nt, Artificial Sequence; identical to SEQ ID NO: 75233
  derived and/or modified sequence opt1 from neuraminidase__InfluenzaA__AFD64134

SEQ ID NO: 82772 - RNA, 1410 nt, Artificial Sequence; identical to SEQ ID NO: 75233
  derived and/or modified sequence opt1 from neuraminidase__InfluenzaA__AFD64145

SEQ ID NO: 82773 - RNA, 1410 nt, Artificial Sequence; identical to SEQ ID NO: 75233
  derived and/or modified sequence opt1 from neuraminidase__InfluenzaA__AFD64156

SEQ ID NO: 82774 - RNA, 1410 nt, Artificial Sequence; identical to SEQ ID NO: 75153
  derived and/or modified sequence opt1 from neuraminidase__InfluenzaA__AFD64167

SEQ ID NO: 82775 - RNA, 1410 nt, Artificial Sequence; identical to SEQ ID NO: 75233
  derived and/or modified sequence opt1 from neuraminidase__InfluenzaA__AFD64181

SEQ ID NO: 82776 - RNA, 1410 nt, Artificial Sequence
  derived and/or modified sequence opt1 from neuraminidase__InfluenzaA__AFD64192
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacgugagcacccugagcggguccgcccagcacguggaggagugcagcugcuacccccgguaccccggcguccgcugcgugugccgggacaacuggaagggcuccaaccgcccgaucguggacaucaacgucaaggacuacagcaucguguccagcuacgugugcuccgggcucgucggcgacacgccccggaagaacgacagcuucuccagcucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggagcaagcccaacuccaagcuccagaucaaccgccaggugaucgucgagcggggcaaccgcagcggguacuccggcaucuucagcguggagggcaaguccugcaucaaccggugcuucuacguggagcugauccgcgggcggaaggaggagaccgaggucugguggacgagcaacagcaucgugguguucugcggcaccuccgggaccuacggcaccgggagcuggccggacggcgccgacaucaaccugaugcccaucuga

SEQ ID NO: 82777 - RNA, 1410 nt, Artificial Sequence
  derived and/or modified sequence opt1 from neuraminidase__InfluenzaA__AFD64203
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcacccgccaggugugcaucgcgugguccagcuccagcugccacgacgggaaggccuggcugcacgucugcgugacgggcgacgacaagaacgccaccgccuccuucaucuacaacgggcggcugguggacagcaucggcuccuggagcaagaagauccuccggacccaggaguccgagugcgucugcaucaacgggaccugcacgguggugaugaccgacggcagcgcguccggcaaggccgacaccaagauccuguucaucgaggaggggaagaucguccacaucagcacccugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuucuccagcucccacugccuggaccccaacaacgaggagggcgggcacggcgucaaggggugggccuucgacgacggcaacgacguguggaugggccggacccugagcgagaagcuccgcuccggguacgagaccuucaaggucaucgagggcuggagcaagcccaacuccaagcugcagaucaaccgccaggugaucguggagcgggggaaccggagcggcuacuccgggaucuucagcgucgagggcaaguccugcaucaaccgcugcuucuacguggagcugauccggggccgcaaggaggagaccgaggugugguggacgagcaacagcaucgucguguucugcgggaccuccggcaccuacgggaccggcagcuggccggacggggccgacaucaaccucaugcccaucuga

SEQ ID NO: 82778 - RNA, 1410 nt, Artificial Sequence; identical to SEQ ID NO: 82738
  derived and/or modified sequence opt1 from neuraminidase__InfluenzaA__AFD64214

SEQ ID NO: 82779 - RNA, 1410 nt, Artificial Sequence; identical to SEQ ID NO: 76937
  derived and/or modified sequence opt1 from neuraminidase__InfluenzaA__AFD64225

SEQ ID NO: 82780 - RNA, 1410 nt, Artificial Sequence; identical to SEQ ID NO: 75233
  derived and/or modified sequence opt1 from neuraminidase__InfluenzaA__AFD64317

SEQ ID NO: 82781 - RNA, 1410 nt, Artificial Sequence; identical to SEQ ID NO: 76939
  derived and/or modified sequence opt1 from neuraminidase__InfluenzaA__AFD64328

SEQ ID NO: 82782 - RNA, 1410 nt, Artificial Sequence; identical to SEQ ID NO: 82738
  derived and/or modified sequence opt1 from neuraminidase__InfluenzaA__AFD64339

SEQ ID NO: 82783 - RNA, 1410 nt, Artificial Sequence; identical to SEQ ID NO: 75233
  derived and/or modified sequence opt1 from neuraminidase__InfluenzaA__AFD64350

SEQ ID NO: 82784 - RNA, 1410 nt, Artificial Sequence; identical to SEQ ID NO: 82738
  derived and/or modified sequence opt1 from neuraminidase__InfluenzaA__AFD64361

SEQ ID NO: 82785 - RNA, 1410 nt, Artificial Sequence; identical to SEQ ID NO: 82738
  derived and/or modified sequence opt1 from neuraminidase__InfluenzaA__AFD64372

SEQ ID NO: 82786 - RNA, 1410 nt, Artificial Sequence; identical to SEQ ID NO: 75233
  derived and/or modified sequence opt1 from neuraminidase__InfluenzaA__AFD64383

SEQ ID NO: 82787 - RNA, 1410 nt, Artificial Sequence; identical to SEQ ID NO: 82738
  derived and/or modified sequence opt1 from neuraminidase__InfluenzaA__AFD64394

SEQ ID NO: 82788 - RNA, 1410 nt, Artificial Sequence; identical to SEQ ID NO: 75233
  derived and/or modified sequence opt1 from neuraminidase__InfluenzaA__AFD64405

SEQ ID NO: 82789 - RNA, 1410 nt, Artificial Sequence; identical to SEQ ID NO: 75233
  derived and/or modified sequence opt1 from neuraminidase__InfluenzaA__AFD64416

SEQ ID NO: 82790 - RNA, 1410 nt, Artificial Sequence; identical to SEQ ID NO: 75233
  derived and/or modified sequence opt1 from neuraminidase__InfluenzaA__AFD64427

SEQ ID NO: 82791 - RNA, 1410 nt, Artificial Sequence
  derived and/or modified sequence opt1 from neuraminidase__InfluenzaA__AFD64438
augaaccccaaccagaagaucaucaccaucggcagcgugucccugaccaucgccgccaucugcuuccucaugcagaucgcgauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaaccuggccgaguaccggaacugguccaagccgcagugcaacaucacgggguucgcccccuucagcaaggacaacuccauccgccucagcgccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccagcuccagcugccacgacggcaaggccuggcugcacgucugcgugacgggggacgacaagaacgccaccgccuccuucaucuacaacggccggcugguggacagcaucggguccuggagcaagaagauccuccgcacccaggaguccgagugcgucugcaucaacgggaccugcacgguggugaugaccgacggcagcgcguccgggaaggccgacaccaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggacgagcaacagcaucgucguguucugcggcaccuccgggaccuacggcaccgggagcuggccggacggcgccgacaucaaccugaugcccaucuga

SEQ ID NO: 82792 - RNA, 1410 nt, Artificial Sequence; identical to SEQ ID NO: 75233
  derived and/or modified sequence opt1 from neuraminidase__InfluenzaA__AFD64449

SEQ ID NO: 82793 - RNA, 1410 nt, Artificial Sequence; identical to SEQ ID NO: 75153
  derived and/or modified sequence opt1 from neuraminidase__InfluenzaA__AFD64460

SEQ ID NO: 82794 - RNA, 1410 nt, Artificial Sequence; identical to SEQ ID NO: 82151
  derived and/or modified sequence opt1 from neuraminidase__InfluenzaA__AFD98098

SEQ ID NO: 82795 - RNA, 1410 nt, Artificial Sequence
  derived and/or modified sequence opt1 from neuraminidase__InfluenzaA__AFD98120
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82796 - RNA, 1410 nt, Artificial Sequence; identical to SEQ ID NO: 80526
  derived and/or modified sequence opt1 from neuraminidase__InfluenzaA__AFD98131

SEQ ID NO: 82797 - RNA, 1410 nt, Artificial Sequence; identical to SEQ ID NO: 82151
  derived and/or modified sequence opt1 from neuraminidase__InfluenzaA__AFD98142

SEQ ID NO: 82798 - RNA, 1410 nt, Artificial Sequence; identical to SEQ ID NO: 82795
  derived and/or modified sequence opt1 from neuraminidase__InfluenzaA__AFD98164

SEQ ID NO: 82799 - RNA, 1410 nt, Artificial Sequence
  derived and/or modified sequence opt1 from neuraminidase__InfluenzaA__AFD98175
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 82800 - RNA, 1410 nt, Artificial Sequence
  derived and/or modified sequence opt1 from neuraminidase__InfluenzaA__AFD98186
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucguggaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucaucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82801 - RNA, 1410 nt, Artificial Sequence; identical to SEQ ID NO: 80526
  derived and/or modified sequence opt1 from neuraminidase__InfluenzaA__AFD98197

SEQ ID NO: 82802 - RNA, 1410 nt, Artificial Sequence; identical to SEQ ID NO: 81263
  derived and/or modified sequence opt1 from neuraminidase__InfluenzaA__AFD98208

SEQ ID NO: 82803 - RNA, 1410 nt, Artificial Sequence
  derived and/or modified sequence opt1 from neuraminidase__InfluenzaA__AFD98218
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucgacgagacgagccggcucggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcugauccgggggcgcaaggaggagaccgaggugcucuggaccagcaacuccaucgucgugagcugcggcacguccgggaccuacggcaccgggagcuggcccgacggcgccgaccugaaccugaugcccaucuga

SEQ ID NO: 82804 - RNA, 1410 nt, Artificial Sequence; identical to SEQ ID NO: 80526
  derived and/or modified sequence opt1 from neuraminidase__InfluenzaA__AFD98229

SEQ ID NO: 82805 - RNA, 1410 nt, Artificial Sequence; identical to SEQ ID NO: 80526
  derived and/or modified sequence opt1 from neuraminidase__InfluenzaA__AFD98240

SEQ ID NO: 82806 - RNA, 1410 nt, Artificial Sequence; identical to SEQ ID NO: 82795
  derived and/or modified sequence opt1 from neuraminidase__InfluenzaA__AFD98251

SEQ ID NO: 82807 - RNA, 1410 nt, Artificial Sequence; identical to SEQ ID NO: 82795
  derived and/or modified sequence opt1 from neuraminidase__InfluenzaA__AFD98262

SEQ ID NO: 82808 - RNA, 1410 nt, Artificial Sequence; identical to SEQ ID NO: 81717
  derived and/or modified sequence opt1 from neuraminidase__InfluenzaA__AFD98273

SEQ ID NO: 82809 - RNA, 1410 nt, Artificial Sequence; identical to SEQ ID NO: 81265
  derived and/or modified sequence opt1 from neuraminidase__InfluenzaA__AFD98283

SEQ ID NO: 82810 - RNA, 1410 nt, Artificial Sequence; identical to SEQ ID NO: 80526
  derived and/or modified sequence opt1 from neuraminidase__InfluenzaA__AFD98293

SEQ ID NO: 82811 - RNA, 1410 nt, Artificial Sequence; identical to SEQ ID NO: 81717
  derived and/or modified sequence opt1 from neuraminidase__InfluenzaA__AFD98313

SEQ ID NO: 82812 - RNA, 1410 nt, Artificial Sequence; identical to SEQ ID NO: 81265
  derived and/or modified sequence opt1 from neuraminidase__InfluenzaA__AFD98323

SEQ ID NO: 82813 - RNA, 1410 nt, Artificial Sequence; identical to SEQ ID NO: 81717
  derived and/or modified sequence opt1 from neuraminidase__InfluenzaA__AFD98333

SEQ ID NO: 82814 - RNA, 1410 nt, Artificial Sequence; identical to SEQ ID NO: 82795
  derived and/or modified sequence opt1 from neuraminidase__InfluenzaA__AFD98343

SEQ ID NO: 82815 - RNA, 1410 nt, Artificial Sequence
  derived and/or modified sequence opt1 from neuraminidase__InfluenzaA__AFD98354
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacgggaacgccuccggcaaggccgacaccaagauccucuucaucgaggagggcaagaucgugcacacgagcacccugcuggggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggacaagggcaaccgguccggguacagcggcaucuucuccgucgagggcaagagcugcaucaaccgcugcuucuacguggagcugauccgggggcgcaaggaggagaccgaggugcuguggaccuccaacagcaucgucguguucugcggcacgagcgggaccuacggcaccggguccuggccggacggcgccgaccucaaccugaugcccaucuga

SEQ ID NO: 82816 - RNA, 1410 nt, Artificial Sequence
  derived and/or modified sequence opt1 from neuraminidase__InfluenzaA__AFD98365
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccaaggugcuguggaccagcaacuccaucgucguguucugcggcacgagcgggaccuacggcaccggguccuggccggacggcgccgaccugaaccucaugcccaucuga

SEQ ID NO: 82817 - RNA, 1410 nt, Artificial Sequence
  derived and/or modified sequence opt1 from neuraminidase__InfluenzaA__AFD98376
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccgggcacugccucgaccccaacaacgaggagggcgggcacggcgucaaggggugggccuucgacgacggcaacgacguguggaugggccgcaccaucaacgagaccagccggcugggguacgagaccuucaaggucaucgagggcugguccaaccccaagagcaagcugcagaucaaccgccaggugaucguggacaaggggaaccgguccggcuacagcgggaucuucuccgucgagggcaagagcugcaucaaccgcugcuucuacguggagcucauccggggccgcaaggaggagaccgaggugcuguggaccuccaacagcaucgucguguucugcgggacgagcggcaccuacgggaccggcuccuggccggacggggccgaccugaaccucaugcccaucuga

SEQ ID NO: 82818 - RNA, 1410 nt, Artificial Sequence
  derived and/or modified sequence opt1 from neuraminidase__InfluenzaA__AFD98387
augaaccccaaccagaagaucaucaccaucggcagcgugucccugaccaucagcacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccgggacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccucgugggcgacacgccccgcaagaacgaccgguccagcaacucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccuccaacagcaucgucguguucugcggcacgagcgggaccuacggcaccggguccuggccggacggcgccgaccucaaccugaugcccaucuga

SEQ ID NO: 82819 - RNA, 1410 nt, Artificial Sequence
  derived and/or modified sequence opt1 from neuraminidase__InfluenzaA__AFD98398
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgcgccaggugugcaucgccuggagcuccagcuccugccacgacgggaaggccuggcuccacgucugcaucaccggcgacgacaagaacgcgaccgccagcuucaucuacaacgggcggcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 82820 - RNA, 1410 nt, Artificial Sequence
  derived and/or modified sequence opt1 from neuraminidase__InfluenzaA__AFD98409
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggacaaggggaaccggagcggcuacuccgggaucuucagcgucgagggcaaguccugcaucaaccgcugcuucuacguggagcucauccggggccgcaaggaggagaccgaggugcuguggaccagcaacagcaucgucguguucugcgggacguccggcaccuacgggaccggcagcuggccggacggggccgaccugaaccucaugcccaucuga

SEQ ID NO: 82821 - RNA, 1410 nt, Artificial Sequence; identical to SEQ ID NO: 82795
  derived and/or modified sequence opt1 from neuraminidase__InfluenzaA__AFD98420

SEQ ID NO: 82822 - RNA, 1410 nt, Artificial Sequence
  derived and/or modified sequence opt1 from neuraminidase__InfluenzaA__AFD98431
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucgugggccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggccggacggggccgaccugaaccucaugcccaucuga

SEQ ID NO: 82823 - RNA, 1410 nt, Artificial Sequence
  derived and/or modified sequence opt1 from neuraminidase__InfluenzaA__AFD98442
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccggcgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucagcuccaacggcgccaacggggugaagggcuucagcuucaaguacgggaacggcguguggaucggccgcaccaaguccaucagcagccggaagggguucgagaugaucugggaccccaacggcuggaccgggaccgacaacaacuucgccaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgcggagcugccguucacgaucgacaaguga

SEQ ID NO: 82824 - RNA, 1410 nt, Artificial Sequence
  derived and/or modified sequence opt1 from neuraminidase__InfluenzaA__AFD98452
augaaccccaaccagaagaucaucacccugggcagcgugucccucaccaucagcacgaucugcuucuucauccagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggccggacggcgccgaccucaaccugaugcccaucuga

SEQ ID NO: 82825 - RNA, 1410 nt, Artificial Sequence; identical to SEQ ID NO: 82795
  derived and/or modified sequence opt1 from neuraminidase__InfluenzaA__AFD98463

SEQ ID NO: 82826 - RNA, 1410 nt, Artificial Sequence
  derived and/or modified sequence opt1 from neuraminidase__InfluenzaA__AFD98474
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82827 - RNA, 1410 nt, Artificial Sequence
  derived and/or modified sequence opt1 from neuraminidase__InfluenzaA__AFD98484
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaugaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 82828 - RNA, 1410 nt, Artificial Sequence
  derived and/or modified sequence opt1 from neuraminidase__InfluenzaA__AFD98495
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccaacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82829 - RNA, 1410 nt, Artificial Sequence; identical to SEQ ID NO: 82795
  derived and/or modified sequence opt1 from neuraminidase__InfluenzaA__AFD98506

SEQ ID NO: 82830 - RNA, 1410 nt, Artificial Sequence
  derived and/or modified sequence opt1 from neuraminidase__InfluenzaA__AFD98517
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 82831 - RNA, 1410 nt, Artificial Sequence; identical to SEQ ID NO: 80526
  derived and/or modified sequence opt1 from neuraminidase__InfluenzaA__AFD98528

SEQ ID NO: 82832 - RNA, 1410 nt, Artificial Sequence; identical to SEQ ID NO: 82795
  derived and/or modified sequence opt1 from neuraminidase__InfluenzaA__AFD98539

SEQ ID NO: 82833 - RNA, 1410 nt, Artificial Sequence; identical to SEQ ID NO: 82795
  derived and/or modified sequence opt1 from neuraminidase__InfluenzaA__AFD98550

SEQ ID NO: 82834 - RNA, 1410 nt, Artificial Sequence
  derived and/or modified sequence opt1 from neuraminidase__InfluenzaA__AFD98561
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaaguccgacagcuccagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 82835 - RNA, 1410 nt, Artificial Sequence
  derived and/or modified sequence opt1 from neuraminidase__InfluenzaA__AFD98572
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgcuggagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggccggacggcgccgaccucaaccugaugcccaucuga

SEQ ID NO: 82836 - RNA, 1410 nt, Artificial Sequence
  derived and/or modified sequence opt1 from neuraminidase__InfluenzaA__AFD98583
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucucccgcgacaacagcauccggcuguccgccggcggggacaucugggucacccgcgagcccuacgugagcugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaaguccgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaaccccaaguccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgaccugaaccucaugcccaucuga

SEQ ID NO: 82837 - RNA, 1410 nt, Artificial Sequence
  derived and/or modified sequence opt1 from neuraminidase__InfluenzaA__AFE02944
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugaacugcauccgccccugcuucugggucgagcucauccggggccgccccaaggagaacaccguguggaccagcggguccagcaucuccuucugcggcgucaacagcgacaccguggggugguccuggcccgacggcgccgagcugccguucacgaucgacaaguga

SEQ ID NO: 82838 - RNA, 1410 nt, Artificial Sequence
  derived and/or modified sequence opt1 from neuraminidase__InfluenzaA__AFE47627
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaccaaccgccaggugaucguggaccggggcaaccggagcggguacuccggcaucuucagcgucgagagcaaguccugcaucaaccgcugcuucuacguggagcugauccggggccgcaagcaggagaccgaggugcuguggaccagcaacuccaucgucguguucugcgggaccagcggcacguacgggaccggcuccuggccggacggggccgacaucaaccucaugcccaucuga

SEQ ID NO: 82839 - RNA, 1410 nt, Artificial Sequence; identical to SEQ ID NO: 82151
  derived and/or modified sequence opt1 from neuraminidase__InfluenzaA__AFF18509

SEQ ID NO: 82840 - RNA, 1410 nt, Artificial Sequence
  derived and/or modified sequence opt1 from neuraminidase__InfluenzaA__AFF57129
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaacggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 82841 - RNA, 1410 nt, Artificial Sequence
  derived and/or modified sequence opt1 from neuraminidase__InfluenzaA__AFF57133
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucagcgugaagcucgccgggaacuccagccugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacagcaacgggaccaucaaggaccggucccccuaccgcacgcugaugagcugcccgaucggcgaggugcccagccccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 82842 - RNA, 1410 nt, Artificial Sequence; identical to SEQ ID NO: 77901
  derived and/or modified sequence opt1 from neuraminidase__InfluenzaA__AFF57137

SEQ ID NO: 82843 - RNA, 1410 nt, Artificial Sequence; identical to SEQ ID NO: 77901
  derived and/or modified sequence opt1 from neuraminidase__InfluenzaA__AFF57141

SEQ ID NO: 82844 - RNA, 1410 nt, Artificial Sequence; identical to SEQ ID NO: 77901
  derived and/or modified sequence opt1 from neuraminidase__InfluenzaA__AFF57145

SEQ ID NO: 82845 - RNA, 1410 nt, Artificial Sequence; identical to SEQ ID NO: 77901
  derived and/or modified sequence opt1 from neuraminidase__InfluenzaA__AFF57149

SEQ ID NO: 82846 - RNA, 1410 nt, Artificial Sequence; identical to SEQ ID NO: 77901
  derived and/or modified sequence opt1 from neuraminidase__InfluenzaA__AFF57153

SEQ ID NO: 82847 - RNA, 1410 nt, Artificial Sequence; identical to SEQ ID NO: 77901
  derived and/or modified sequence opt1 from neuraminidase__InfluenzaA__AFF57157

SEQ ID NO: 82848 - RNA, 1410 nt, Artificial Sequence; identical to SEQ ID NO: 77901
  derived and/or modified sequence opt1 from neuraminidase__InfluenzaA__AFF57161

SEQ ID NO: 82849 - RNA, 1410 nt, Artificial Sequence; identical to SEQ ID NO: 77901
  derived and/or modified sequence opt1 from neuraminidase__InfluenzaA__AFF57165

SEQ ID NO: 82850 - RNA, 1410 nt, Artificial Sequence; identical to SEQ ID NO: 77901
  derived and/or modified sequence opt1 from neuraminidase__InfluenzaA__AFF57169

SEQ ID NO: 82851 - RNA, 1410 nt, Artificial Sequence; identical to SEQ ID NO: 77901
  derived and/or modified sequence opt1 from neuraminidase__InfluenzaA__AFF57173

SEQ ID NO: 82852 - RNA, 1410 nt, Artificial Sequence; identical to SEQ ID NO: 77901
  derived and/or modified sequence opt1 from neuraminidase__InfluenzaA__AFF57177

SEQ ID NO: 82853 - RNA, 1410 nt, Artificial Sequence; identical to SEQ ID NO: 77901
  derived and/or modified sequence opt1 from neuraminidase__InfluenzaA__AFF57181

SEQ ID NO: 82854 - RNA, 1410 nt, Artificial Sequence; identical to SEQ ID NO: 77901
  derived and/or modified sequence opt1 from neuraminidase__InfluenzaA__AFF57185

SEQ ID NO: 82855 - RNA, 1410 nt, Artificial Sequence; identical to SEQ ID NO: 77901
  derived and/or modified sequence opt1 from neuraminidase__InfluenzaA__AFF57189

SEQ ID NO: 82856 - RNA, 1350 nt, Artificial Sequence
  derived and/or modified sequence opt1 from neuraminidase__InfluenzaA__AFF60789
augaaccccaacaagaagaucaucaccaucggcagcaucugcauggugaccgggauggucucccugaugcuccagaucggcaaccugaucagcaucugggugucccacagcauccacacggggaaccagcacaaggccgagccgaucuccaacaccaacuuccugaccgagaaggccguggcgagcgucaagcucgccggcaacuccagccugugccccaucaacgggugggccguguacuccaaggacaacagcauccgcaucggcuccaagggcgacguguucgucauccgggagcccuucaucagcugcucccaccuggagugccgcaccuucuuccucacgcagggggcccugcugaacgacaagcacagcaacggcaccgugaaggaccggagcccccaccgcacccucauguccugcccggugggggaggcccccucccccuacaacagccgguucgaguccgucgcguggagcgccagcgccugccacgacggcaccuccuggcugacgaucgggaucagcggccccgacaacggcgccguggcggugcugaaguacaacgggaucaucaccgacaccaucaaguccuggcgcaacaacauccuccggacccaggagagcgagugcgccugcgucaacggcuccugcuucacggugaugaccgacgggccgagcaacggccaggccucccacaagaucuucaagauggagaagggcaagguggucaagagcguggagcuggacgcccccaacuaccacuacgaggagugcuccugcuaccccgacgccggggagaucacgugcgugugccgcgacaacuggcacggcagcaaccggcccugggucuccuucaaccagaaccuggaguaccagaucggguacaucugcagcggcguguucggggacaacccgcgccccaacgacggcaccggcuccugcgggcccgugagcuccaacggcgcguacggggucaagggcuucagcuucaaguacgggaacggcguguggaucggccggaccaaguccaccaacagccgcuccggguucgagaugaucugggaccccaacggcuggaccgagaccgacagcagcuucuccgugaagcaggacaucgucgccaucacggacuggagcggguacuccggcagcuucgugcagcacccggagcucaccgggcuggacugcauccggcccugcuucugggucgagcugauccgcggccggcccaaggaguccaccaucuggaccagcggcuccagcaucuccuucugcggggugacgagcgacaccgugggcugguccuggcccgacggggccgagcucccguucaccaucgacaaguga

SEQ ID NO: 82857 - RNA, 1410 nt, Artificial Sequence
  derived and/or modified sequence opt1 from neuraminidase__InfluenzaA__AFG29043
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccauccgggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 82858 - RNA, 1410 nt, Artificial Sequence; identical to SEQ ID NO: 79527
  derived and/or modified sequence opt1 from neuraminidase__InfluenzaA__AFG29045

SEQ ID NO: 82859 - RNA, 1410 nt, Artificial Sequence; identical to SEQ ID NO: 79659
  derived and/or modified sequence opt1 from neuraminidase__InfluenzaA__AFG31063

SEQ ID NO: 82860 - RNA, 1410 nt, Artificial Sequence; identical to SEQ ID NO: 77746
  derived and/or modified sequence opt1 from neuraminidase__InfluenzaA__AFG31073

SEQ ID NO: 82861 - RNA, 1410 nt, Artificial Sequence
  derived and/or modified sequence opt1 from neuraminidase__InfluenzaA__AFG31083
augaaccccaaccagaagaucaucaccaucggcagcgugugcaugaccaucgggauggccaaccugauccuccagaucggcaacaucaucuccaucuggaucagccacuccauccagcuggucaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugagcgggugggccaucuacuccaaggacaacagcgugcgcaucggcuccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcucaccaucgggaucuccggccccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacgggccguccaacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 82862 - RNA, 1410 nt, Artificial Sequence; identical to SEQ ID NO: 77746
  derived and/or modified sequence opt1 from neuraminidase__InfluenzaA__AFG31093

SEQ ID NO: 82863 - RNA, 1410 nt, Artificial Sequence; identical to SEQ ID NO: 77746
  derived and/or modified sequence opt1 from neuraminidase__InfluenzaA__AFG31103

SEQ ID NO: 82864 - RNA, 1410 nt, Artificial Sequence; identical to SEQ ID NO: 77746
  derived and/or modified sequence opt1 from neuraminidase__InfluenzaA__AFG31113

SEQ ID NO: 82865 - RNA, 1410 nt, Artificial Sequence; identical to SEQ ID NO: 77746
  derived and/or modified sequence opt1 from neuraminidase__InfluenzaA__AFG31123

SEQ ID NO: 82866 - RNA, 1410 nt, Artificial Sequence; identical to SEQ ID NO: 77746
  derived and/or modified sequence opt1 from neuraminidase__InfluenzaA__AFG31133

SEQ ID NO: 82867 - RNA, 1410 nt, Artificial Sequence; identical to SEQ ID NO: 77746
  derived and/or modified sequence opt1 from neuraminidase__InfluenzaA__AFG31143

SEQ ID NO: 82868 - RNA, 1410 nt, Artificial Sequence; identical to SEQ ID NO: 77746
  derived and/or modified sequence opt1 from neuraminidase__InfluenzaA__AFG31153

SEQ ID NO: 82869 - RNA, 1410 nt, Artificial Sequence; identical to SEQ ID NO: 77746
  derived and/or modified sequence opt1 from neuraminidase__InfluenzaA__AFG31163

SEQ ID NO: 82870 - RNA, 1410 nt, Artificial Sequence
  derived and/or modified sequence opt1 from neuraminidase__InfluenzaA__AFG31173
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccugcccaaggagaacaccaucuggaccagcggguccagcaucuccuucugcggcgugaacagcgacaccgucgggugguccuggcccgacggcgccgagcugccguucacgaucgacaaguga

SEQ ID NO: 82871 - RNA, 1410 nt, Artificial Sequence; identical to SEQ ID NO: 82870
  derived and/or modified sequence opt1 from neuraminidase__InfluenzaA__AFG31183

SEQ ID NO: 82872 - RNA, 1410 nt, Artificial Sequence; identical to SEQ ID NO: 77746
  derived and/or modified sequence opt1 from neuraminidase__InfluenzaA__AFG31193

SEQ ID NO: 82873 - RNA, 1410 nt, Artificial Sequence; identical to SEQ ID NO: 77746
  derived and/or modified sequence opt1 from neuraminidase__InfluenzaA__AFG31203

SEQ ID NO: 82874 - RNA, 1410 nt, Artificial Sequence; identical to SEQ ID NO: 77746
  derived and/or modified sequence opt1 from neuraminidase__InfluenzaA__AFG31213

SEQ ID NO: 82875 - RNA, 1410 nt, Artificial Sequence; identical to SEQ ID NO: 77746
  derived and/or modified sequence opt1 from neuraminidase__InfluenzaA__AFG31223

SEQ ID NO: 82876 - RNA, 1410 nt, Artificial Sequence; identical to SEQ ID NO: 77746
  derived and/or modified sequence opt1 from neuraminidase__InfluenzaA__AFG31233

SEQ ID NO: 82877 - RNA, 1410 nt, Artificial Sequence
  derived and/or modified sequence opt1 from neuraminidase__InfluenzaA__AFG31243
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgucgccggccagagcgugguguccgucaagcuggcggggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 82878 - RNA, 1410 nt, Artificial Sequence; identical to SEQ ID NO: 80738
  derived and/or modified sequence opt1 from neuraminidase__InfluenzaA__AFG31253

SEQ ID NO: 82879 - RNA, 1410 nt, Artificial Sequence; identical to SEQ ID NO: 77746
  derived and/or modified sequence opt1 from neuraminidase__InfluenzaA__AFG31263

SEQ ID NO: 82880 - RNA, 1410 nt, Artificial Sequence; identical to SEQ ID NO: 77746
  derived and/or modified sequence opt1 from neuraminidase__InfluenzaA__AFG31273

SEQ ID NO: 82881 - RNA, 1410 nt, Artificial Sequence; identical to SEQ ID NO: 77746
  derived and/or modified sequence opt1 from neuraminidase__InfluenzaA__AFG31283

SEQ ID NO: 82882 - RNA, 1410 nt, Artificial Sequence; identical to SEQ ID NO: 77746
  derived and/or modified sequence opt1 from neuraminidase__InfluenzaA__AFG31293

SEQ ID NO: 82883 - RNA, 1410 nt, Artificial Sequence; identical to SEQ ID NO: 77746
  derived and/or modified sequence opt1 from neuraminidase__InfluenzaA__AFG31303

SEQ ID NO: 82884 - RNA, 1410 nt, Artificial Sequence; identical to SEQ ID NO: 77746
  derived and/or modified sequence opt1 from neuraminidase__InfluenzaA__AFG31313

SEQ ID NO: 82885 - RNA, 1410 nt, Artificial Sequence; identical to SEQ ID NO: 77746
  derived and/or modified sequence opt1 from neuraminidase__InfluenzaA__AFG31326

SEQ ID NO: 82886 - RNA, 1410 nt, Artificial Sequence; identical to SEQ ID NO: 77746
  derived and/or modified sequence opt1 from neuraminidase__InfluenzaA__AFG31336

SEQ ID NO: 82887 - RNA, 1410 nt, Artificial Sequence; identical to SEQ ID NO: 80738
  derived and/or modified sequence opt1 from neuraminidase__InfluenzaA__AFG31346

SEQ ID NO: 82888 - RNA, 1410 nt, Artificial Sequence; identical to SEQ ID NO: 80738
  derived and/or modified sequence opt1 from neuraminidase__InfluenzaA__AFG31356

SEQ ID NO: 82889 - RNA, 1410 nt, Artificial Sequence; identical to SEQ ID NO: 80738
  derived and/or modified sequence opt1 from neuraminidase__InfluenzaA__AFG31366

SEQ ID NO: 82890 - RNA, 1410 nt, Artificial Sequence; identical to SEQ ID NO: 80738
  derived and/or modified sequence opt1 from neuraminidase__InfluenzaA__AFG31379

SEQ ID NO: 82891 - RNA, 1410 nt, Artificial Sequence; identical to SEQ ID NO: 80738
  derived and/or modified sequence opt1 from neuraminidase__InfluenzaA__AFG31389

SEQ ID NO: 82892 - RNA, 1410 nt, Artificial Sequence; identical to SEQ ID NO: 80738
  derived and/or modified sequence opt1 from neuraminidase__InfluenzaA__AFG31399

SEQ ID NO: 82893 - RNA, 1410 nt, Artificial Sequence; identical to SEQ ID NO: 80738
  derived and/or modified sequence opt1 from neuraminidase__InfluenzaA__AFG31409

SEQ ID NO: 82894 - RNA, 1410 nt, Artificial Sequence; identical to SEQ ID NO: 77746
  derived and/or modified sequence opt1 from neuraminidase__InfluenzaA__AFG31419

SEQ ID NO: 82895 - RNA, 1410 nt, Artificial Sequence; identical to SEQ ID NO: 77746
  derived and/or modified sequence opt1 from neuraminidase__InfluenzaA__AFG31429

SEQ ID NO: 82896 - RNA, 1410 nt, Artificial Sequence; identical to SEQ ID NO: 77746
  derived and/or modified sequence opt1 from neuraminidase__InfluenzaA__AFG31439

SEQ ID NO: 82897 - RNA, 1410 nt, Artificial Sequence; identical to SEQ ID NO: 77746
  derived and/or modified sequence opt1 from neuraminidase__InfluenzaA__AFG31449

SEQ ID NO: 82898 - RNA, 1410 nt, Artificial Sequence; identical to SEQ ID NO: 77746
  derived and/or modified sequence opt1 from neuraminidase__InfluenzaA__AFG31459

SEQ ID NO: 82899 - RNA, 1410 nt, Artificial Sequence; identical to SEQ ID NO: 77746
  derived and/or modified sequence opt1 from neuraminidase__InfluenzaA__AFG31469

SEQ ID NO: 82900 - RNA, 1410 nt, Artificial Sequence; identical to SEQ ID NO: 77746
  derived and/or modified sequence opt1 from neuraminidase__InfluenzaA__AFG31479

SEQ ID NO: 82901 - RNA, 1410 nt, Artificial Sequence; identical to SEQ ID NO: 77746
  derived and/or modified sequence opt1 from neuraminidase__InfluenzaA__AFG31499

SEQ ID NO: 82902 - RNA, 1410 nt, Artificial Sequence; identical to SEQ ID NO: 79637
  derived and/or modified sequence opt1 from neuraminidase__InfluenzaA__AFG31509

SEQ ID NO: 82903 - RNA, 1410 nt, Artificial Sequence; identical to SEQ ID NO: 80738
  derived and/or modified sequence opt1 from neuraminidase__InfluenzaA__AFG31519

SEQ ID NO: 82904 - RNA, 1410 nt, Artificial Sequence; identical to SEQ ID NO: 77746
  derived and/or modified sequence opt1 from neuraminidase__InfluenzaA__AFG31529

SEQ ID NO: 82905 - RNA, 1410 nt, Artificial Sequence; identical to SEQ ID NO: 79637
  derived and/or modified sequence opt1 from neuraminidase__InfluenzaA__AFG31539

SEQ ID NO: 82906 - RNA, 1410 nt, Artificial Sequence; identical to SEQ ID NO: 77746
  derived and/or modified sequence opt1 from neuraminidase__InfluenzaA__AFG31549

SEQ ID NO: 82907 - RNA, 1410 nt, Artificial Sequence; identical to SEQ ID NO: 77746
  derived and/or modified sequence opt1 from neuraminidase__InfluenzaA__AFG31559

SEQ ID NO: 82908 - RNA, 1410 nt, Artificial Sequence; identical to SEQ ID NO: 80738
  derived and/or modified sequence opt1 from neuraminidase__InfluenzaA__AFG31569

SEQ ID NO: 82909 - RNA, 1410 nt, Artificial Sequence; identical to SEQ ID NO: 77746
  derived and/or modified sequence opt1 from neuraminidase__InfluenzaA__AFG31579

SEQ ID NO: 82910 - RNA, 1410 nt, Artificial Sequence; identical to SEQ ID NO: 77746
  derived and/or modified sequence opt1 from neuraminidase__InfluenzaA__AFG31589

SEQ ID NO: 82911 - RNA, 1410 nt, Artificial Sequence; identical to SEQ ID NO: 77746
  derived and/or modified sequence opt1 from neuraminidase__InfluenzaA__AFG31599

SEQ ID NO: 82912 - RNA, 1410 nt, Artificial Sequence; identical to SEQ ID NO: 77746
  derived and/or modified sequence opt1 from neuraminidase__InfluenzaA__AFG31609

SEQ ID NO: 82913 - RNA, 1410 nt, Artificial Sequence; identical to SEQ ID NO: 77746
  derived and/or modified sequence opt1 from neuraminidase__InfluenzaA__AFG31619

SEQ ID NO: 82914 - RNA, 1410 nt, Artificial Sequence; identical to SEQ ID NO: 77746
  derived and/or modified sequence opt1 from neuraminidase__InfluenzaA__AFG31629

SEQ ID NO: 82915 - RNA, 1410 nt, Artificial Sequence; identical to SEQ ID NO: 80738
  derived and/or modified sequence opt1 from neuraminidase__InfluenzaA__AFG31639

SEQ ID NO: 82916 - RNA, 1410 nt, Artificial Sequence; identical to SEQ ID NO: 77746
  derived and/or modified sequence opt1 from neuraminidase__InfluenzaA__AFG31649

SEQ ID NO: 82917 - RNA, 1410 nt, Artificial Sequence; identical to SEQ ID NO: 77746
  derived and/or modified sequence opt1 from neuraminidase__InfluenzaA__AFG31659

SEQ ID NO: 82918 - RNA, 1410 nt, Artificial Sequence; identical to SEQ ID NO: 77746
  derived and/or modified sequence opt1 from neuraminidase__InfluenzaA__AFG31669

SEQ ID NO: 82919 - RNA, 1410 nt, Artificial Sequence; identical to SEQ ID NO: 75103
  derived and/or modified sequence opt1 from neuraminidase__InfluenzaA__AFG71868

SEQ ID NO: 82920 - RNA, 1410 nt, Artificial Sequence; identical to SEQ ID NO: 75103
  derived and/or modified sequence opt1 from neuraminidase__InfluenzaA__AFG71890

SEQ ID NO: 82921 - RNA, 1410 nt, Artificial Sequence; identical to SEQ ID NO: 75103
  derived and/or modified sequence opt1 from neuraminidase__InfluenzaA__AFG71901

SEQ ID NO: 82922 - RNA, 1410 nt, Artificial Sequence; identical to SEQ ID NO: 75122
  derived and/or modified sequence opt1 from neuraminidase__InfluenzaA__AFG71912

SEQ ID NO: 82923 - RNA, 1410 nt, Artificial Sequence
  derived and/or modified sequence opt1 from neuraminidase__InfluenzaA__AFG71934
augaaccccaaccagaagaucaucaccaucggcagcgugucccugaccaucgccacggucugcuuccucaugcagaucgccauccugaucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggugugcaucgccugguccagcuccagcugccacgacggcaaggcguggcuccacgucugcgugaccggggacgacaagaacgccacggccuccuucaucuacgacggccggcugguggacagcaucggguccuggagccagaacauccugcgcacccaggaguccgagugcgucugcaucaacgggaccugcaccguggugaugacggacggcagcgccuccggccgggcggacacccgcauccucuucaucgaggagggcaagaucguccacaucagcccccugagcggguccgcccagcacguggaggagugcagcugcuacccccgguacccgggcgugcgcugcaucugccgggacaacuggaagggcuccaaccgccccgucguggacaucaacgugaaggacuacagcaucgacucccgguacgucugcagcgggcuggugggcgacacgccccgcaacaacgaccgguucuccaacagcaacugccgcaaccccaacaacgagcgggggaaccacggcgugaaggggugggccuucgacgacggcaacgacgucuggaugggccgcaccaucuccaaggacagccgguccggguacgagaccuucaaggugaucggcggguggagcaccccgaacuccaagagccagaucaaccgccaggucaucguggacuccgacaaccgcagcggcuacuccgggaucuucagcguggagggcaaguccugcaucaaccggugcuucuacgucgagcucauccgcggccgggagcaggagacccgcgugugguggaccagcaacagcaucguggucuucugcgggacguccggcaccuacgggaccggcagcuggcccgacggggccgacaucaaccugaugcccaucuga

SEQ ID NO: 82924 - RNA, 1410 nt, Artificial Sequence
  derived and/or modified sequence opt1 from neuraminidase__InfluenzaA__AFG71945
augaaccccaaccagaagaucaucaccaucggcagcgugucccugaccaucgccacggucugcuuccucaugcagaucgccauccuggugaccaccgugacccugcacuucaagcaguacgagugcgacagcccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcgugcccuuccaccuggggacccgccaggucugcaucgccugguccagcuccagcugccacgacggcaaggcguggcuccacgugugcgugaccggggacgacgagaacgccacggccuccuucaucuacgacggccggcuggucgacagcaucggguccuggagccagaacauccugcgcacccaggaguccgagugcgugugcaucaacgggaccugcaccguggucaugacggacggcagcgccuccggccgggcggacacccgcauccucuucaucgaggagggcaagaucgugcacaucagcccccugagcggguccgcccagcacguggaggagugcagcugcuacccccgguacccgggcguccgcugcaucugccgggacaacuggaagggcuccaaccgccccgugguggacaucaacgucaaggacuacagcaucgacucccgguacgugugcagcgggcuggugggcgacacgccccgcaacaacgacaaguccagcaacuccaacugccggaaccccaacaacgacaaggggaaccacggcgucaaggggugggccuucgacgacggcaacgacguguggaugggccgcaccaucagcaaggacucccggagcggguacgagaccuucaaggucaucggcgggugguccaccccgaacagcaagucccagaucaaccgccaggugaucguggacagcgacaaccgguccggcuacagcgggaucuucuccgucgagggcaagagcugcaucaaccgcugcuucuacguggagcucauccgcggccgggagcaggagaccaaggugugguggaccagcaacuccaucgucguguucugcgggacgagcggcaccuacgggaccggcuccuggcccgacggggccgacaucaaccugaugagcaucuga

SEQ ID NO: 82925 - RNA, 1410 nt, Artificial Sequence; identical to SEQ ID NO: 75126
  derived and/or modified sequence opt1 from neuraminidase__InfluenzaA__AFG71967

SEQ ID NO: 82926 - RNA, 1410 nt, Artificial Sequence; identical to SEQ ID NO: 75126
  derived and/or modified sequence opt1 from neuraminidase__InfluenzaA__AFG71978

SEQ ID NO: 82927 - RNA, 1410 nt, Artificial Sequence
  derived and/or modified sequence opt1 from neuraminidase__InfluenzaA__AFG71988
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcaucugcaucaacgggaccugcacggucgugaugaccgacggcagcgccuccggccgggcggacaccaagauccucuucaucgaggagggcaagaucgugcacaucagcccccugagcggguccgcccagcacgucgaggagugcagcugcuacccccgcuacccgggcgugcggugcaucugccgcgacaacuggaagggcuccaaccggcccguggucgacaucaacgugaaggacuacagcaucgacuccagcuacgugugcuccgggcuggucggcgacacgccccgcaacaacgaccggagcuccaacagcuacugccgcaaccccaacaacgagaaggggaaccacggcgugaaggggugggccuucgacgacggcaacgacguguggaugggccggaccaucuccgaggacagccgcuccggguacgagaccuucaaggucaucggcggguggagcaccccgaacuccaagcuccagaucaaccgccaggugaucgucgacagcgacaaccgguccggcuacagcgggaucuucuccguggagggcaagagcugcaucaaccggugcuucuacguggagcugauccgcggccgcgagcaggagacccgggucugguggacgagcaacuccaucgugguguucugcgggaccagcggcaccuacgggaccggcuccuggcccgacggggccgacaucaaccugaugcccaucuga

SEQ ID NO: 82928 - RNA, 1410 nt, Artificial Sequence; identical to SEQ ID NO: 75126
  derived and/or modified sequence opt1 from neuraminidase__InfluenzaA__AFG71999

SEQ ID NO: 82929 - RNA, 1410 nt, Artificial Sequence; identical to SEQ ID NO: 75584
  derived and/or modified sequence opt1 from neuraminidase__InfluenzaA__AFG72021

SEQ ID NO: 82930 - RNA, 1410 nt, Artificial Sequence
  derived and/or modified sequence opt1 from neuraminidase__InfluenzaA__AFG72032
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacgggguacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgacaaccgguccggguacagcggcaucuucagcguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 82931 - RNA, 1410 nt, Artificial Sequence; identical to SEQ ID NO: 75821
  derived and/or modified sequence opt1 from neuraminidase__InfluenzaA__AFG72088

SEQ ID NO: 82932 - RNA, 1410 nt, Artificial Sequence
  derived and/or modified sequence opt1 from neuraminidase__InfluenzaA__AFG72121
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccgcgugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacagcauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggagcuccagcuccugccacgacggcaaggccuggcuccacgugugcgugaccgggcacgacgagaacgcgaccgccagcuucaucuacgacggccgccuggucgacuccaucgggagcugguccaagaacauccugcggacccaggagagcgagugcgugugcaucaacggcacgugcaccguggucaugaccgacggcuccgccagcgagcgcgccgacaccaagauccucuucaucgaggaggggaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccuggucggggacacgccccggaagaacgaccgcuccagcuccagcuacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccgcugcuucuacguggagcugauccgcgggcggaagcaggagacgcgcgucugguggaccuccaacagcaucgugguguucugcggcaccuccgggaccuacggcacggggagcuggcccgacggcgccgacaucaaccucaugcccaucuga

SEQ ID NO: 82933 - RNA, 1410 nt, Artificial Sequence
  derived and/or modified sequence opt1 from neuraminidase__InfluenzaA__AFG72143
augaaccccaaccagaagaucaucaccaucggcagcgugucccugaccaucgccacgaucugccuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacagcauccgccucuccgccggcggggacaucugggugacccgggagcccuacgucagcugcgacccgggcaagugcuaccaguucgcccuggggcagggcaccacgcugaacaaccgccacuccaacgacaccgugcacgaccggacccccuaccgcacccuccugaugaacgagcugggcgugcccuuccaccucgggacgaagcaggucugcaucgccuggagcuccagcuccugccacgacggcaaggccuggcugcacgugugcgugaccgggcacgacgagaacgcgaccgccagcuucaucuacgacggccggcuggucgacuccaucgggagcugguccaagaacauccuccgcacccaggagagcgagugcgugugcaucaacggcacgugcaccguggucaugaccgacggcuccgccagcgagcgggccgacaccaagauccuguucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcuccuacugccggaacccgaacaacgagaagggcagccacggggugaagggcugggccuucgacgacgggaacgacgucuggaugggccgcaccaucggcgaggagcugcgguccggguacgagaccuucaaggugaucggcggguggagcacccccaacuccaagcugcagaucaaccgccaggugaucgucgacagcggcaaccgguccggguacagcggcaucuucagcguggagggcaaguccugcaucaaccgcugcuucuacguggagcucauccgggggcgcaagcaggagacgaaggucugguggaccagcaacuccaucgugguguucugcggcaccagcgggaccuacggcacgggguccuggcccgacggcgccgacaucaaccugaugcccaucuga

SEQ ID NO: 82934 - RNA, 1410 nt, Artificial Sequence
  derived and/or modified sequence opt1 from neuraminidase__InfluenzaA__AFG72165
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacauccugcgcacccaggaguccgagugcgugugcaucaacgggacgugcaccgucgugaugaccgacggcagcgccuccgagcgggccgacaccaagauccucuucaucgaggagggcaagaucgugcacaucagcccccugagcggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacagcaagcugcagacgaaccgccaggucaucguggaccgggggaaccgcuccggcuacagcgggaucuucuccguggagggcaagagcugcaucaaccggugcuucuacgucgagcugauccgcggccgcaagcaggagaccaaggugugguggaccagcaacuccaucguggucuucugcgggaccagcggcacguacgggaccggcuccuggcccgacggggccgacaucaaccucaugcccaucuga

SEQ ID NO: 82935 - RNA, 1410 nt, Artificial Sequence
  derived and/or modified sequence opt1 from neuraminidase__InfluenzaA__AFG72176
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaagugccccaagcugguggaguaccggaacugguccaagccgcagugcaagaucaccggguucgcccccuucagcaaggacaacuccauccgccucagcgcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccagcuccagcugccacgacggcaaggccuggcugcacgugugcgugaccgggcacgacgagaacgccaccgcguccuucaucuacgacggccggcuggucgacagcaucggguccuggagcaagaacauccuccgcacgcaggaguccgagugcgugugcaucaacgggaccugcaccguggucaugaccgacggcagcgccuccgagcgggccgacacgaagauccuguucaucgaggagggcaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggcguucgacgacgggaacgacgucuggaugggccgcaccaucagcgaggagcugcgguccggcuacgagaccuucaaggugaucgggggcuggagcaccccgaacuccaagcugcagaucaaccgccaggugaucgucgaccgggggaaccgcagcggcuacuccgggaucuucagcguggagggcaagagcugcaucaaccggugcuucuacguggagcucauccgcggccgcaagcaggagaacaaggucugguggaccuccaacagcaucgugguguucugcgggaccuccggcaccuacgggacgggcagcuggcccgacggggccgacaucaaccugaugcccaucuga

SEQ ID NO: 82936 - RNA, 1410 nt, Artificial Sequence; identical to SEQ ID NO: 82934
  derived and/or modified sequence opt1 from neuraminidase__InfluenzaA__AFG72198

SEQ ID NO: 82937 - RNA, 1410 nt, Artificial Sequence; identical to SEQ ID NO: 82934
  derived and/or modified sequence opt1 from neuraminidase__InfluenzaA__AFG72209

SEQ ID NO: 82938 - RNA, 1410 nt, Artificial Sequence
  derived and/or modified sequence opt1 from neuraminidase__InfluenzaA__AFG72220
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 82939 - RNA, 1410 nt, Artificial Sequence; identical to SEQ ID NO: 82934
  derived and/or modified sequence opt1 from neuraminidase__InfluenzaA__AFG72231

SEQ ID NO: 82940 - RNA, 1410 nt, Artificial Sequence
  derived and/or modified sequence opt1 from neuraminidase__InfluenzaA__AFG72297
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaagaucaccggguucgcccccuucagcaaggacaacuccauccggcucagcgccggcggggacaucugggugacccgcgagcccuacguguccugcgaccccggcaagugcuaccaguucgcccuggggcagggcaccacgcugaacaaccggcacagcaacgacaccguccacgagcgcaccccguaccggacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccgccugguggacagcaucggguccuggagcaagaacauccuccggacccaggaguccgagugcgucugcaucaacggcacgugcaccguggugaugaccgacggcagcgccuccgagcgcgcggacaccaagauccuguucaucgaggaggggaagaucguccacaucagcccccugagcggcuccgcccagcacguggaggagugcagcugcuacccccgguacccgggggugcgcugcgucugccgggacaacuggaagggcuccaaccgccccaucguggacaucaacgugaaggacuacagcaucgucuccagcuacgugugcuccggccucgugggggacacgccccggaagaacgacagcuccagcuccagcuacugccgcaaccccaacaacgagaagggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccgcggccggaagcaggagaccgaggugugguggacguccaacagcaucgucguguucugcgggaccuccggcaccuacgggaccggcagcuggcccgacggggccgacaucaaccugaugcccaucuga

SEQ ID NO: 82941 - RNA, 1410 nt, Artificial Sequence
  derived and/or modified sequence opt1 from neuraminidase__InfluenzaA__AFG72308
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcugcggagcggcuacgagaccuuccgcgucaucgggggcugguccaagccgaacagcaagcugcagaucaaccgccaggugaucguggaccgggggaaccgguccggcuacagcgggaucuucagcgucgagggcaaguccugcaucaaccgcugcuucuacguggagcucauccgcggccggaagcaggagaccgaggugugguggacgagcaacuccaucgucguguucugcgggaccagcggcaccuacgggaccggcuccuggcccgacggggccgacaucaaccugaugcccaucuga

SEQ ID NO: 82942 - RNA, 1410 nt, Artificial Sequence; identical to SEQ ID NO: 76193
  derived and/or modified sequence opt1 from neuraminidase__InfluenzaA__AFG72320

SEQ ID NO: 82943 - RNA, 1410 nt, Artificial Sequence
  derived and/or modified sequence opt1 from neuraminidase__InfluenzaA__AFG72331
augaaccccaaccagaagaucaucaccaucggcagcgugucccugaccgucgccacgaucugcuuccucaugcagaucgccauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcuggucgacagcaucggguccuggagcaagaacauccuccgcacccaggaguccgagugcgugugcaucaacggcacgugcaccguggucaugaccgacggcagcgccuccgagcgggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggugaucgucgaccgggggaaccgcagcggcuacuccgggaucuucagcguggagggcaagagcugcaucaaccggugcuucuacguggagcucauccgcggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 82944 - RNA, 1410 nt, Artificial Sequence
  derived and/or modified sequence opt1 from neuraminidase__InfluenzaA__AFG72353
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgacagcggcaagugcuaccaguucgcccuggggcagggcaccacgcugaacaaccgccacuccaacgacaccguccacgaccggacccccuaccgcacccuccugaugaacgagcugggcgugccguuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcuccuacugccggaaccccaacaacgagaagggcagccacggggucaagggcugggccuucgacgacgggaacgacguguggaugggccgcaccaucuccgaggagcugcggagcggcuacgagaccuucaaggucaucgggggcugguccaagcccaacagcaagcugcagaucaaccgccaggugaucguggaccgggggaaccgcuccggcuacagcgggaucuucagcgucgagggcaaguccugcaucaaccggugcuucuacguggagcucauccgcggccgcaagcaggagaccgaggugugguggacgagcaacuccaucgucguguucugcgggaccagcggcaccuacgggaccggcuccuggccggacggggccgacaucaaccugaugcccaucuga

SEQ ID NO: 82945 - RNA, 1410 nt, Artificial Sequence; identical to SEQ ID NO: 76193
  derived and/or modified sequence opt1 from neuraminidase__InfluenzaA__AFG72364

SEQ ID NO: 82946 - RNA, 1410 nt, Artificial Sequence
  derived and/or modified sequence opt1 from neuraminidase__InfluenzaA__AFG72430
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagccagcugagcggguccgcgcagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuccagcuccagcaacugccuggaccccaacaacgaggagggcgggcacggggucaagggcugggccuucgacgacggcaacgacguguggauggggcggaccaucuccgagaagcugcgcagcggcuacgagaccuucaaggucaucgggggcugguccaagcccaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggccggacggcgccgacaucaaccugaugcccaucuga

SEQ ID NO: 82947 - RNA, 1410 nt, Artificial Sequence; identical to SEQ ID NO: 76193
  derived and/or modified sequence opt1 from neuraminidase__InfluenzaA__AFG72452

SEQ ID NO: 82948 - RNA, 1410 nt, Artificial Sequence
  derived and/or modified sequence opt1 from neuraminidase__InfluenzaA__AFG72474
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcgagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 82949 - RNA, 1410 nt, Artificial Sequence
  derived and/or modified sequence opt1 from neuraminidase__InfluenzaA__AFG72485
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 82950 - RNA, 1410 nt, Artificial Sequence; identical to SEQ ID NO: 76109
  derived and/or modified sequence opt1 from neuraminidase__InfluenzaA__AFG72507

SEQ ID NO: 82951 - RNA, 1410 nt, Artificial Sequence
  derived and/or modified sequence opt1 from neuraminidase__InfluenzaA__AFG72529
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaagauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccagaaccccaacaacgagaacggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 82952 - RNA, 1410 nt, Artificial Sequence
  derived and/or modified sequence opt1 from neuraminidase__InfluenzaA__AFG72540
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucaagaaggagaucugccccaagcuggcggaguaccggaacuggagcaagccccagugcaagaucaccggguucgcccccuucuccaaggacaacagcauccgccucuccgccggcggggacaucugggugacccgggagcccuacgugagcugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugcuggaacccgaacaacgagaagggcgggcacggcgucaaggggugggccuucgacgacggcaacgacguguggaugggccggaccaucagcgaggagcugcgcuccggguacgagaccuucaaggucaucggcggguggagcaagcccaacuccaagcugcagaucaaccgccaggugaucguggaccggggcaaccggagcggguacuccggcaucuucagcgucgagggcaaguccugcaucaaccgcugcuucuacguggagcucauccgggggcgcaagcaggagaccgaggugugguggacgagcaacagcaucgucguguucugcggcaccuccgggaccuacggcaccgggagcuggcccgacggcgccgacaucaaccugaugcccaucuga

SEQ ID NO: 82953 - RNA, 1410 nt, Artificial Sequence
  derived and/or modified sequence opt1 from neuraminidase__InfluenzaA__AFG72562
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagcugcgcagcggguacgagaccuucaaggucaucggcgggugguccaagccgaacagcaagcugcagaucaaccgccaggugaucguggaccggggcaaccgguccggguacagcggcaucuucuccgucgagggcaagagcugcaucaaccgcugcuucuacguggagcucauccgggggcgcaagcaggagaccgaggugugguggacgagcaacuccaucgucguguucugcggcaccagcgggaccuacggcaccggguccuggcccgacggcgccgacaucaaccugaugcccaucuga

SEQ ID NO: 82954 - RNA, 1410 nt, Artificial Sequence
  derived and/or modified sequence opt1 from neuraminidase__InfluenzaA__AFG72584
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccggcaagugcuaccaguucgcccuggggcagggcaccacgcugaacaacaagcacagcaacgacaccgugcacgaccgcaccccguaccggacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccgccuggucgacagcaucggguccuggagcaagaacauccuccggacccaggaguccgagugcgugugcaucaacggcacgugcaccguggucaugaccgacggcagcgccuccgagaaggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagcugcgcagcggguacgagaccuucaaggugaucggcgggugguccaagccgaacagcaagcugcagaucaaccgccaggugaucgucgaccggggcaaccgguccggguacagcggcaucuucuccguggagggcaagagcugcaucaaccgcugcuucuacguggagcucauccgggggcgcaagcaggagaccgaggucugguggacgagcaacuccaucgugguguucugcggcaccagcgggaccuacggcaccggguccuggcccgacggcgccgacaucaaccugaugcccaucuga

SEQ ID NO: 82955 - RNA, 1410 nt, Artificial Sequence
  derived and/or modified sequence opt1 from neuraminidase__InfluenzaA__AFG72606
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggaccacagcaucgucuccagcuacgugugcuccggccucgugggggacacgccccgcaagaacgacagcuccagcuccagcuacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggguacagcggcaucuucuccgucgagggcaagagcugcgugaaccgcugcuucuacguggagcugauccgggggcgcaagcaggagaccgaggucugguggacgagcaacuccaucgugguguucugcggcaccagcgggaccuacggcaccggguccuggcccgacggcgccgacaucaaccugaugcccaucuga

SEQ ID NO: 82956 - RNA, 1410 nt, Artificial Sequence
  derived and/or modified sequence opt1 from neuraminidase__InfluenzaA__AFG72617
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 82957 - RNA, 1410 nt, Artificial Sequence
  derived and/or modified sequence opt1 from neuraminidase__InfluenzaA__AFG72628
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuacgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcugcgcuccggguacgagaccuucaaggucaucggcggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggacguccaacagcaucgucguguucugcggcaccuccgggaccuacggcaccgggagcuggccggacggcgccgacaucaaccugaugcccaucuga

SEQ ID NO: 82958 - RNA, 1410 nt, Artificial Sequence; identical to SEQ ID NO: 75988
  derived and/or modified sequence opt1 from neuraminidase__InfluenzaA__AFG72639

SEQ ID NO: 82959 - RNA, 1410 nt, Artificial Sequence
  derived and/or modified sequence opt1 from neuraminidase__InfluenzaA__AFG72650
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggguacagcggcaucuucuccgucgagggcaagagcugcgugaaccgcugcuucuacguggagcugauccgggggcgcaagcaggagaccgaggucugguggacgagcaacuccaucgugguguucugcggcaccagcgggaccuacggcaccggguccuggcccgacggcgccgacaucaaccugaugcccaucuga

SEQ ID NO: 82960 - RNA, 1410 nt, Artificial Sequence; identical to SEQ ID NO: 82957
  derived and/or modified sequence opt1 from neuraminidase__InfluenzaA__AFG72672

SEQ ID NO: 82961 - RNA, 1407 nt, Artificial Sequence
  derived and/or modified sequence opt1 from neuraminidase__InfluenzaA__AFG72683
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgagguccacgaccggacgccguaccgcacccuccugaugaacgagcugggcgugcccuuccaccucgggaccaagcaggucugcaucgccugguccagcuccagcugccacgacggcaaggcguggcugcacgugugcgugaccgggcacaacgagaacgccacggccuccuucaucuacgacggccggcugguggacagcaucggguccuggagcaagaacauccuccgcacccaggaguccgagugcgucugcaucaacgggaccugcaccguggugaugacggacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcggccacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggaccagcaacuccaucgucguguucugcgggaccagcggcacguacgggaccggcuccuggcccgacggcgccgacaucaaccugaugcccaucuga

SEQ ID NO: 82962 - RNA, 1410 nt, Artificial Sequence
  derived and/or modified sequence opt1 from neuraminidase__InfluenzaA__AFG72705
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagccagcugagcggcuccgcccagcacguggaggagugcagcugcuacccccgcuaccccggggugcggugcgucugccgcgacaacuggaagggcuccaaccggccgaucguggacaucaacgugaaggaccacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagaccgaggugugguggacgagcaacuccaucgucguguucugcgggaccagcggcaccuacgggaccggcuccuggccggacggggccgacaucaaccugaugcccaucuga

SEQ ID NO: 82963 - RNA, 1410 nt, Artificial Sequence
  derived and/or modified sequence opt1 from neuraminidase__InfluenzaA__AFG72716
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagcccccugagcggguccgcgcagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccuggaccccaacaacgaggagggcgggcacggggucaagggcugggccuucgacgacggcaacgacguguggauggggcggaccaucuccgagaagucccgcagcggcuacgagaccuucaaggucaucgggggcuggagcaagccgaacuccaagcugcagaucaaccgccaggugaucguggaccgggggaaccggagcggcuacuccggcaucuucagcgucgagggcaagagcugcaucaaccgcugcuucuacguggagcucauccgggggcgccgccaggagaccgaggugugguggacguccaacagcaucgucguguucugcgggaccuccggcaccuacgggaccggcagcuggcccgacggcgccgacaucaaccugaugcccaucuga

SEQ ID NO: 82964 - RNA, 1410 nt, Artificial Sequence
  derived and/or modified sequence opt1 from neuraminidase__InfluenzaA__AFG72738
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggccgacaccaagauccuguucaucgaggagggcaagaucguccacaucagccagcugagcggguccgcgcagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuccagcuccagcuacugccuggaccccaacaacgaggagggcgggcacggggucaagggcugggccuucgacgacggcaacgacguguggauggggcggaccaucuccgagaagcugcgcagcggcuacgagaccuucaaggucaucgggggcugguccaagcccaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggccggacggcgccgacaucaaccugaugcccaucuga

SEQ ID NO: 82965 - RNA, 1410 nt, Artificial Sequence; identical to SEQ ID NO: 76193
  derived and/or modified sequence opt1 from neuraminidase__InfluenzaA__AFG72749

SEQ ID NO: 82966 - RNA, 1410 nt, Artificial Sequence; identical to SEQ ID NO: 75581
  derived and/or modified sequence opt1 from neuraminidase__InfluenzaA__AFG72760

SEQ ID NO: 82967 - RNA, 1410 nt, Artificial Sequence; identical to SEQ ID NO: 75048
  derived and/or modified sequence opt1 from neuraminidase__InfluenzaA__AFG72771

SEQ ID NO: 82968 - RNA, 1410 nt, Artificial Sequence
  derived and/or modified sequence opt1 from neuraminidase__InfluenzaA__AFG72782
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacacgagccagcucagcggcuccgcccagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacaccccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggagacggaggugugguggaccagcaacuccaucguggucuucugcggcaccagcgggaccuacggcacgggguccuggcccgacggcgccgacaucaaccugaugccgaucuga

SEQ ID NO: 82969 - RNA, 1410 nt, Artificial Sequence; identical to SEQ ID NO: 76757
  derived and/or modified sequence opt1 from neuraminidase__InfluenzaA__AFG72793

SEQ ID NO: 82970 - RNA, 1410 nt, Artificial Sequence; identical to SEQ ID NO: 75292
  derived and/or modified sequence opt1 from neuraminidase__InfluenzaA__AFG72804

SEQ ID NO: 82971 - RNA, 1410 nt, Artificial Sequence; identical to SEQ ID NO: 76937
  derived and/or modified sequence opt1 from neuraminidase__InfluenzaA__AFG72826

SEQ ID NO: 82972 - RNA, 1410 nt, Artificial Sequence
  derived and/or modified sequence opt1 from neuraminidase__InfluenzaA__AFG72837
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgagggcaaguccugcaucaaccgcugcuucuacguggagcugauccgggggcgcaaggaggagaccgaggugugguggaccagcaacagcaucgucguguucugcggcaccuccgggaccuacggcacggggagcuggccggacggcgccgacaucaaccugaugcccaucuga

SEQ ID NO: 82973 - RNA, 1413 nt, Artificial Sequence
  derived and/or modified sequence opt1 from neuraminidase__InfluenzaA__AFG72848
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaaguccgcggaguaccggaacuggagcaagccgcagugcaacaucaccggguucgcccccuucuccaaggacaacagcauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccaccuggggacgcgccaggugugcaucgccuggagcuccagcuccugccacgacggcaaggcguggcuccacgucugcgugaccggggacgacaagaacgccaccgccagcuucaucuacaacggccggcugguggacuccaucgggagcugguccaagaaguacauccugcgcacccaggagagcgagugcgucugcaucaacggcacgugcaccguggugaugaccgacggcuccgccagcgggaaggcggacaccaagauccucuucaucgaggagggcaagaucauccacaucagcacgcuguccgggagcgcccagcacgucgaggagugcuccugcuacccccgguaccccggcgugcgcugcgugugccgggacaacuggaagggcagcaaccgcccgaucgucgacaucaacgugaaggacuacuccaucgugagcuccuacgucugcagcgggcuggugggcgacacgccccggaagaacgacuccagcuccagcucccacugccucgaccccaacaacgaggagggcgggcacggggugaagggcugggccuucgacgacggcaacgacgucuggauggggcgcaccaucagcgagaagcugcgguccggcuacgagaccuucaaggugaucgagggguggagcaagcccaacuccaagcugcagaucaaccgccaggucaucguggagcggggcaaccgcagcggguacuccggcaucuucagcguggagggcaagagcugcaucaaccggugcuucuacgucgagcucauccgcgggcggaaggaggagaccgaggugugguggaccuccaacagcaucguggucuucugcggcaccuccgggaccuacggcacggggagcuggccggacggcgccgacaucaaccugaugcccaucuga

SEQ ID NO: 82974 - RNA, 1410 nt, Artificial Sequence
  derived and/or modified sequence opt1 from neuraminidase__InfluenzaA__AFG72859
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgaccgcaccccguaccggacccugcucaugaacgagcugggcgugcccuuccaccugggcaccaagcaggucugcaucgccuggagcuccagcuccugccacgacgggaaggccuggcuccacgugugcgugacgggcgacgacgagaacgcgaccgccagcuucaucuacaacgggcgccugguggacuccaucgucagcugguccaagaagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 82975 - RNA, 1410 nt, Artificial Sequence
  derived and/or modified sequence opt1 from neuraminidase__InfluenzaA__AFG72870
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcaccuccgggaaggccgacacgaagauccuguucaucgaggagggcaagaucguccacaucagcacccugagcggguccgcgcagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcucgugggcgacacgccccgcaagaacgacagcuucuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggagcggggcaaccggagcggguacuccggcaucuucagcgucgaguccaagagcugcaucaaccgcugcuucuacguggagcugauccggggccgcaaggaggagaccgaggugugguggaccagcaacuccaucgucguguucugcgggaccagcggcacguacgggaccggcuccuggccggacggggccgacaucaaccugaugcccaucuga

SEQ ID NO: 82976 - RNA, 1410 nt, Artificial Sequence
  derived and/or modified sequence opt1 from neuraminidase__InfluenzaA__AFG72892
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggagaagaccgaggugcuguggaccuccaacagcaucgucguguucugcggcaccuccgggacguacggcaccgggagcuggccggacggcgccgacaucaaccugaugcccaucuga

SEQ ID NO: 82977 - RNA, 1410 nt, Artificial Sequence
  derived and/or modified sequence opt1 from neuraminidase__InfluenzaA__AFG72903
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaaggacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcgaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 82978 - RNA, 1410 nt, Artificial Sequence
  derived and/or modified sequence opt1 from neuraminidase__InfluenzaA__AFG72936
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaucguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 82979 - RNA, 1410 nt, Artificial Sequence
  derived and/or modified sequence opt1 from neuraminidase__InfluenzaA__AFG72958
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaucguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgaccugaaccucaugcccaucuga

SEQ ID NO: 82980 - RNA, 1410 nt, Artificial Sequence; identical to SEQ ID NO: 75111
  derived and/or modified sequence opt1 from neuraminidase__InfluenzaA__AFG98811

SEQ ID NO: 82981 - RNA, 1410 nt, Artificial Sequence
  derived and/or modified sequence opt1 from neuraminidase__InfluenzaA__AFG98822
augaaccccaaccagaagaucaucaccaucggcagcgugucccugaucaucgccaccgucugcuuccucaugcagaucgccauccuggugacgaccgugacccugcacuucaagcagcacgagugcgacagcccguccagcaaccaggucaugcucugcgagcccaucaucaucgagcgcaacaucaccgagaucguguaccugaacaacacgaccaucgagaaggagaccugccccaagcugguggaguaccggaacugguccaagccccagugcaagaucaccggguucgcgccguucagcaaggacaacuccauccgccucagcgccggcggggacaucugggucacgcgggagcccuacguguccugcgaccccggcaagugcuaccaguucgcccuggggcagggcaccacccuggacaacaagcacagcaacgacaccauccacgaccgcaucccccaccggacgcuccugaugaacgagcugggcgugccguuccaccucgggacccgccaggucugcaucgccugguccagcuccagcugccacgacggcaaggccuggcugcacgugugcgugaccggggacgacaagaacgcgaccgccuccuucaucuacgacggccggcuggucgacagcaucggguccuggagccagaacauccuccgcacgcaggaguccgagugcgugugcaucaacgggaccugcaccguggucaugaccgacggcagcgccagcggccgggccgacacgcgcauccuguucaucgaggagggcaagaucgugcacaucagcccccuguccggguccgcgcagcacguggaggagugcagcugcuacccccgguaccccgacguccgcugcaucugccgggacaacuggaagggcuccaaccgcccgaucguggacaucaacaugaaggacuacagcaucgacuccagcuacgugugcuccggccucgucggggacacgccccggaacgacgaccgcagcuccaagagcaacugccggaaccccaacaacgagcgcggcaaccacggggugaagggcugggccuucgacaacgggaacgacguguggaugggccggaccaucuccaaggaccugcgcagcggcuacgagaccuucaaggucaucgggggcugguccacccccaacagcaagucccagaucaaccgccaggugaucgucgacagcgacaaccgguccggguacagcggcaucuucagcguggaggggaaguccugcaucaaccgcugcuucuacguggagcugauccggggccgcgagcaggagacccgggucugguggaccagcaacuccaucgugguguucugcggcaccagcgggacguacggcaccggguccuggccggacggcgccaacaucaacuucaugcccaucuga

SEQ ID NO: 82982 - RNA, 1410 nt, Artificial Sequence; identical to SEQ ID NO: 81135
  derived and/or modified sequence opt1 from neuraminidase__InfluenzaA__AFG98833

SEQ ID NO: 82983 - RNA, 1410 nt, Artificial Sequence
  derived and/or modified sequence opt1 from neuraminidase__InfluenzaA__AFG98844
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaugugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccugaacaaccgccacagcaacgacacgauccacgaccggaucccgcaccgcacccugcucaugaacgagcugggcgugcccuuccaccuggggacccgccaggugugcaucgccugguccagcuccagcugccacgacggcaaggcguggcuccacgucugcgugaccggggacgacaagaacgccacggccuccuucaucuacgacggccgccugguggacagcaucggguccuggagccagaacauccugcggacccaggaguccgagugcgucugcaucaaccggaccugcaccguggugaugacggacggcagcgccuccggcaaggcggacacccggauccucuucaucgaggaggggaagaucguccacaucagcccccugagcggcuccgcccagcacguggaggagugcagcugcuacccccgcuacccgggggugcggugcaucugccgcgacaacuggaagggcuccaaccggcccgucguggacaucaacgugaaggacuacagcaucgacuccagcuacgucugcuccggccuggugggggacacgccccgcaacaacgaccggagcuccagcuccuacugccgcaaccccaacaacgagcggggcaaccacggggugaagggcugggccuucgacgacgagaacgacgucuggauggggcgcaccaucagcaaggacucccggagcggcuacgagaccuucaaggugaucggcgggugguccaccccgaacagcaagucccagaucaaccgccaggucaucguggacagcgacaaccgcuccggcuacagcgggaucuucagcguggagggcaaguccugcaucaaccggugcuucuacgucgagcucauccgcgggcgggagcaggagacccgcgugugguggaccagcaacuccaucguggucuucugcggcacgagcggcaccuacgggaccggcuccuggcccgacggggccgacaucaaccugaugcccaucuga

SEQ ID NO: 82984 - RNA, 1410 nt, Artificial Sequence; identical to SEQ ID NO: 75126
  derived and/or modified sequence opt1 from neuraminidase__InfluenzaA__AFG98855

SEQ ID NO: 82985 - RNA, 1410 nt, Artificial Sequence; identical to SEQ ID NO: 75980
  derived and/or modified sequence opt1 from neuraminidase__InfluenzaA__AFG98866

SEQ ID NO: 82986 - RNA, 1410 nt, Artificial Sequence
  derived and/or modified sequence opt1 from neuraminidase__InfluenzaA__AFG98877
augaaccccaaccagaagaucaucaccaucggcagcgugucccugaccaucgccacgaucugcuuccucaugcagaucgccauccuggucaccaccgugacccugcacuucaagcaguacgagugcgacagcccgcccaacaaccaggugaugcccugcgagcccaucaucaucgagcgcaacaucacggagaucgucuaccucaccaacaccaccaucgagaaggagaucugcccgaagcugguggaguaccggaacugguccaagccccagugcaagaucacgggguucgcgcccuucagcaaggacaacuccauccgccugagcgccggcggggacaucugggugacccgggagcccuacgucuccugcgacccgggcaagugcuaccaguucgcccucgggcagggcaccacccuggacaacaagcacagcaacgacacgauccacgaccgcacgccccaccggacccugcucaugaacgagcugggcgugcccuuccaccuggggacccgccaggugugcaucgccugguccagcuccagcugccacgacggcaaggccuggcuccacgucugcgugaccggguacgacaagaacgcgaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggccgacaccaagauccucuucaucgaggagggcaagaucguccacaucagcccccugagcggguccgcgcagcacguggaggagugcagcugcuacccgcgcuaccccggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaacccgaacaacgagaaggggaaccacggcgugaaggggugggccuucgacgacggcaacgacgucuggaugggccggaccaucuccgaggacagccgcuccggguacgagaccuucaaggugaucggcggguggagcacccccaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacgggaccggcuccuggcccgacggggccgacaucaaccugaugcccaucuga

SEQ ID NO: 82987 - RNA, 1410 nt, Artificial Sequence; identical to SEQ ID NO: 75126
  derived and/or modified sequence opt1 from neuraminidase__InfluenzaA__AFG98888

SEQ ID NO: 82988 - RNA, 1410 nt, Artificial Sequence
  derived and/or modified sequence opt1 from neuraminidase__InfluenzaA__AFG98899
augaaccccaaccagaagaucaucaccaucggcagcgugucccugaucaucgccaccaucugcuuccucaugcagaucgccauccuggucacgaccgugacccugcacuucaagcaguacgagugcgacagcccggcgaacaaccaggugaugcccugcgagcccaucaucaucgagcgcaacaucaccgagaucgucuaccucacgaacaccaccaucgagaaggagaucugccccaagcugguggaguaccggaacugguccaagccgcagugcaagaucaccggguucgcccccuucagcaaggacaacuccauccgccugagcgccggcggggacaucugggugacgcgggagcccuacgucuccugcgaccccggcaagugcuaccaguucgcccucgggcagggcaccacccuggacaacaagcacagcaacgacaccauccacgaccgcacgccgcaccggacccugcucaugaacgagcugggcgugcccuuccaccuggggacccgccaggugugcaucgccugguccagcuccagcugccacgacggcaaggcguggcuccacgucugcgugaccggguacgacaagaacgccacggccuccuucaucuacgacggccggcugguggacagcaucggguccuggagccagaacauccugcgcacccaggaguccgagugcgucugcaucaacgggaccugcaccguggugaugacggacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggaccagcaacuccaucguggucuucugcgggacgagcggcaccuacgggaccggcuccuggcccgacggggccgacaucaaccugaugcccaucuga

SEQ ID NO: 82989 - RNA, 1410 nt, Artificial Sequence; identical to SEQ ID NO: 75126
  derived and/or modified sequence opt1 from neuraminidase__InfluenzaA__AFG98910

SEQ ID NO: 82990 - RNA, 1410 nt, Artificial Sequence; identical to SEQ ID NO: 75126
  derived and/or modified sequence opt1 from neuraminidase__InfluenzaA__AFG98921

SEQ ID NO: 82991 - RNA, 1410 nt, Artificial Sequence
  derived and/or modified sequence opt1 from neuraminidase__InfluenzaA__AFG98932
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucgucgagcgcaacaucacggagaucguguaccucaccaacaccaccaucgagaaggagaucugccccaagcugguggaguaccggaagugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggucugcaucgccugguccagcuccagcugccacgacggcaaggcguggcuccacgugugcgugacgggguacgacaagaacgccaccgccuccuucaucuacgacggccggcuggucgacagcaucggguccuggagccagaacauccugcgcacccaggaguccgagugcgugugcaucaacgggaccugcacgguggucaugaccgacggcagcgccuccggccgggcggacaccaagauccucuucaucgaggagggcaagaucgugcacaucagcccccugagcggguccgcccagcacguggaggagugcagcugcuacccccgcuacccgggcguccggugcaucugccgcgacaacuggaagggcuccaaccggcccgugguggacaucaacgucaaggacuacagcaucgacuccagcuacgugugcuccgggcuggugggcgacacgccccgcaacaacgaccggagcuccaacagcuacugccgcaaccccaacaacgagaaggggaaccacggcgucaaggggugggccuucgacgacggcaacgacguguggaugggccggaccaucuccgaggacagccgcuccggguacgagaccuucaaggucaucggcggguggagcaccccgaacuccaagcuccagaucaaccgccaggugaucguggacagcgacaaccgguccggcuacagcgggaucuucuccgucgagggcaagagcugcaucaaccggugcuucuacguggagcugauccgcggccgcgagcaggagacccgggugugguggacgagcaacuccaucgucguguucugcgggaccagcggcaccuacgggaccggcuccuggcccgacggggccgacaucaaccugaugcccaucuga

SEQ ID NO: 82992 - RNA, 1410 nt, Artificial Sequence
  derived and/or modified sequence opt1 from neuraminidase__InfluenzaA__AFG98943
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaagaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacgggaccggcuccuggcccgacggggccgacaucgaccugaugcccaucuga

SEQ ID NO: 82993 - RNA, 1410 nt, Artificial Sequence
  derived and/or modified sequence opt1 from neuraminidase__InfluenzaA__AFG98965
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccacgaucaucgagcgcaacaucaccgagaucgucuaccucaccaacaucaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccaacagcuacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggagcaccccgaacuccaagcuccagaucaaccggcaggucaucguggacagcgacaaccgcuccggcuacagcgggaucuucuccguggagggcaagagcugcaucaaccggugcuucuacgucgagcugauccgcggccgcgagcaggagacccgggugugguggacgagcaacuccaucguggucuucugcgggaccagcggcaccuacggggccggcuccuggcccgacggggccgacaucaaccugaugcccaucuga

SEQ ID NO: 82994 - RNA, 1410 nt, Artificial Sequence
  derived and/or modified sequence opt1 from neuraminidase__InfluenzaA__AFG98976
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucgccaacaccaccaucgagaaggagaucugccccaagcugguggaguaccggaacugguccaagccgcagugcaagaucaccggguucgcccccuucagcaaggacaacuccauccgccugagcgccggcggggacaucugggugacgcgggagcccuacgucuccugcgaccccggcaagugcuaccaguucgcccucgggcagggcaccacccuggacaacaagcacagcaacgacaccauccacgaccgcacgccgcaccggacccugcucaugaacgagcugggcgugcccuuccaccuggggacccgccaggugugcaucgcgugguccagcuccagcugccacgacggcaaggccuggcuccacgucugcgugaccggguacgacaagaacgccacggccuccuucaucuacgacggccggcugguggacagcaucggguccuggagcaagaacauccugcgcacccaggaguccgagugcgucugcaucaacgggaccugcaccguggugaugacggacggcagcgcguccggccgggccgacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggaaccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgacaaccgcagcggcuacuccgggguguucagcgucgagggcaagagcugcaucaaccggugcuucuacguggagcugauccgcggccgcgagcuggagacccgggugugguggaccuccaacagcaucgucguguucugcgggacguccggcaccuacgggaccggcagcuggcccgacggggccgacaucaaccucaugcccaucuga

SEQ ID NO: 82995 - RNA, 1410 nt, Artificial Sequence; identical to SEQ ID NO: 82994
  derived and/or modified sequence opt1 from neuraminidase__InfluenzaA__AFG98987

SEQ ID NO: 82996 - RNA, 1410 nt, Artificial Sequence
  derived and/or modified sequence opt1 from neuraminidase__InfluenzaA__AFG98998
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggagaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaagaacgaccggagcuccagcuccuacugccgcaaccccaacaacgagaaggggaaccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgccaaccgcagcggcuacuccgggaucuucagcguggagggcaagagcugcaucaaccggugcuucuacgucgagcugauccgcggccgcgagcaggagacccgggugugguggacguccaacagcaucguggucuucugcgggaccuccggcaccuacgggaccggcagcuggcccgacggggccgacaucaaccugaugcccaucuga

SEQ ID NO: 82997 - RNA, 1410 nt, Artificial Sequence; identical to SEQ ID NO: 82994
  derived and/or modified sequence opt1 from neuraminidase__InfluenzaA__AFG99009

SEQ ID NO: 82998 - RNA, 1410 nt, Artificial Sequence
  derived and/or modified sequence opt1 from neuraminidase__InfluenzaA__AFG99020
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaacaacgaccggagcuccagcuccuacugccgcaaccccaacaacgagaaggggacccacggcgugaaggggugggccuucgacgacggcaacgacgucuggaugggccggaccaucagcgaggacucccgcagcggguacgagaccuucaaggugaucggcgggugguccacgccgaacagcaagcuccagaucaaccggcaggucaucguggacuccgacaaccgcagcggcuacuccgggaucuucagcguggagggcaagagcugcaucaaccggugcuucuacgucgagcugauccgcggccgcgagcaggagacccgggugugguggaccuccaacagcaucguggucuucugcgggaccuccggcacguacgggaccggcagcuggcccgacggggccgacaucaacaucaugcccaucuga

SEQ ID NO: 82999 - RNA, 1410 nt, Artificial Sequence
  derived and/or modified sequence opt1 from neuraminidase__InfluenzaA__AFG99031
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcccccugagcggguccgcccagcacguggaggagugcagcugcuacccccgcuacccgggcgugcggugcaucugccgcgacaacuggcggggcuccaaccgccccgucguggacaucaacgugaaggacuacagcaucgacuccagcuacgucugcuccgggcuggugggcgacacgccccggaacaacgaccgcagcuccagcuccuacugccggaaccccaacaacgagaaggggacccacggcgugaaggggugggccuucgacgacggcaacgacgucuggaugggccgcaccaucagcgaggacucccggagcggguacgagaccuucaaggugaucggcgggugguccacgccgaacagcaagcuccagaucaaccgccaggucaucguggacuccgacaaccggagcggcuacuccgggaucuucagcguggagggcaagagcugcaucaaccgcugcuucuacgucgagcuggugcgcggccgggagcaggagacccgcgugugguggaccuccaacagcaucgucguguucugcgggaccuccggcacguacgggaccggcagcuggcccgacggggccgacaucaaccugaugcccaucuga

SEQ ID NO: 83000 - RNA, 1410 nt, Artificial Sequence; identical to SEQ ID NO: 75584
  derived and/or modified sequence opt1 from neuraminidase__InfluenzaA__AFG99042

SEQ ID NO: 83001 - RNA, 1410 nt, Artificial Sequence
  derived and/or modified sequence opt1 from neuraminidase__InfluenzaA__AFG99053
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaccagcagccuguccgggagcgcccagcacguggaggagugcuccugcuacccccgcuaccccggcgugcggugcaucugccgcgacaacuggaagggcagcaaccggccggucguggacaucaacgugaaggacuacuccaucgacagcuccuacgucugcagcgggcuggugggcgacacgccccgcaacaacgaccgguccagcuccagcuacugccgcaaccccaacaacgagaaggggacccacggcgugaaggggugggccuucgacgacggcaacgacgucuggaugggccggaccaucuccgaggacagccgcuccggguacgagaccuucaaggugaucggcggguggagcauccccaacuccaagcuccagaucaaccggcaggucaucguggacagcgacaaccgcuccggcuacagcgggaucuucagcguggagggcaaguccugcaucaaccggugcuucuacgucgagcugauccgcggccgcgagcaggagacgcgggugugguggaccagcaacuccaucguggucuucugcgggaccagcggcaccuacgggacgggcuccuggccggacggggccgacaucaaccugaugcccaucuga

SEQ ID NO: 83002 - RNA, 1410 nt, Artificial Sequence
  derived and/or modified sequence opt1 from neuraminidase__InfluenzaA__AFG99064
augaaccccaaccagaagaucaucaccaucggcagcgugucccugaccaucgccacggucugcuuccucaugcagaucgccauccuggugaccaccgugacccugcacuucaagcaguacgagugcgacagcccgcccaacaaccaggucaugcccugcgagcccaucaucaucgagcgcaacgugacggagaucguguaccucaccaacaccaccaucgagaaggagaucugcccgaagcuggucgaguaccggaacugguccaagccccagugcaagaucacgggguucgcgcccuucagcaaggacaacuccauccgccugagcgccggcggggacaucugggugacccgggagcccuacguguccugcgacccgagcaagugcuaccaguucgcccucggccaggggaccacccuggacaacaagcacuccaacgacacgauccacgaccgcacgccccaccggacccugcucaugaacgagcugggcguccccuuccaccugggcacccgccaggugugcaucgccuggagcuccagcuccugccacgacgggaaggccuggcuccacgugugcaucaccggcuacgacaagaacgcgaccgccagcuucaucuacgacgggcggcuggucgacuccaucggcagcugguccaagaacauccugcgcacccaggagagcgagugcgugugcaucaacgggaccugcacgguggucaugaccgacggcuccgccagcgagcgggccgacaccaagauccucuucaucgaggagggcaagaucgugcacaucagcccccuguccgggagcgcgcagcacguggaggagugcuccugcuacccgcgcuaccccggcguccggugcaucugccgcgacaacuggaaggggagcaaccggcccgugguggacaucaacgucaaggacuacuccaucgugagcuccuacgugugcagcggccuggucggcgacacgccccgcaagaacgaccgguccagcuccagcuacugccgcaacccgaacaacgagaaggggaaccacggcgugaaggggugggccuucgacgacggcaacgacgucuggauggggcggaccaucuccgaggagagccgcuccggcuacgagaccuucaaggugaucggcggguggagcacccccaacuccaagcuccagaucaaccgccaggugaucgucgacagcgacaaccgguccggcuacagcgggaucuucagcguggagggcaaguccugcaucaaccggugcuucuacguggagcugauccgcgggcgcgagcaggagacccgggucugguggacgagcaacuccaucgugguguucugcggcaccagcggcaccuacgggaccggcuccuggcccgacggggccgacaucaaccugaugcccaucuga

SEQ ID NO: 83003 - RNA, 1410 nt, Artificial Sequence
  derived and/or modified sequence opt1 from neuraminidase__InfluenzaA__AFG99086
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaccccguaccggacccugcucaugaacgagcugggcgugcccuuccaccuggggacccgccaggucugcaucgccugguccagcuccagcugccacgacggcaaggcguggcuccacgugugcgugacgggguacgacaagaacgccaccgccuccuucaucuacgacggccggcuggucgacagcaucggguccuggagcaagaacauccugcgcacccaggaguccgagugcgugugcaucaacgggaccugcacgguggucaugaccgacggcagcgccuccgagcgggcggacaccaagauccucuucaucgaggaggggaagaucgugcacaucagcccccugagcggcuccgcccagcacguggaggagugcagcugcuacccccgcuacccggggguccggugcaucugccgcgacaacuggaagggcuccaaccggcccgugguggacaucaacgucaaggacuacagcaucguguccagcuacgugugcuccggccuggucggggacacgccccgcaagaacgaccggagcuccagcuccuacugccgcaaccccaacaacgagaagggcaaccacggggugaagggcugggccuucgacgacgggaacgacgucuggaugggccggaccaucagcgaggagucccgcagcggcuacgagaccuucaaggugaucgggggcugguccaccccgaacagcaagcuccagaucaaccgccaggugaucgucgacuccgacaaccggagcggguacuccggcaucuucagcguggagggcaagagcugcaucaaccggugcuucuacguggagcugauccgcggccgcgagcaggagacccgggucugguggacguccaacagcaucgugguguucugcggcaccuccgggaccuacggcaccgggagcuggcccgacggcgccgacaucaaccugaugcccaucuga

SEQ ID NO: 83004 - RNA, 1410 nt, Artificial Sequence
  derived and/or modified sequence opt1 from neuraminidase__InfluenzaA__AFG99097
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccucgggcagggcaccacccuggacaacaagcacagcaacgacacgauccacgaccgcaccccguaccggacccugcucaugaacgagcugggcgugcccuuccaccuggggacccgccaggucugcaucgccugguccagcuccagcugccacgacggcaaggcguggcuccacgugugcgugacgggguacgacaagaacgccaccgccuccuucaucuacgacggccggcuggucgacagcaucggguccuggagcaagaacauccugcgcacccaggaguccgagugcgugugcaucaacgggaccugcacgguggucaugaccgacggcagcgccuccgagcgggcggacaccaagauccucuucaucgaggaggggaagaucgugcacaucagcccccugagcggcuccgcccagcacguggaggagugcagcugcuacccccgcuacccggggguccggugcaucugccgcgacaacuggaagggcuccaaccggcccgugguggacaucaacgucaaggacuacagcaucguguccagcuacgugugcuccggccuggucggggacacgccccgcaagaacgaccggagcuccagcuccuacugccgcaaccccaacaacgagaagggcaaccacggggugaagggcugggccuucgacgacgggaacgacgucuggaugggccggaccaucagcgaggagucccgccucggcuacgagaccuucaaggugaucgggggcuggagcaccccgaacuccaagcugcagaucaaccgccaggugaucgucgacagcgacaaccgguccggguacagcggcaucuucuccguggagggcaagagcugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccucaugcccaucuga

SEQ ID NO: 83005 - RNA, 1410 nt, Artificial Sequence
  derived and/or modified sequence opt1 from neuraminidase__InfluenzaA__AFG99119
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacggggcacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccuggugggggacacgccccgcaagaacgaccgguccagcuccagcuacugccgcaacccgaacaacgagaagggcaaccacggggucaagggcugggccuucgacgacgggaacgacguguggaugggccggaccaucuccgaggagagccgcuccggcuacgagaccuucaaggucaucgggggcuggagcacccccaacuccaagcuccagaucaaccgccaggugaucguggacagcgacaaccgguccggguacagcggcaucuucagcgucgaggggaaguccugcaucaaccggugcuucuacguggagcugauccgcggccgcgagcaggagacccgggugugguggacgagcaacuccaucgucguguucugcggcaccagcgggaccuacggcaccggguccuggcccgacggcgccgacaucaaccugaugcccaucuga

SEQ ID NO: 83006 - RNA, 1410 nt, Artificial Sequence
  derived and/or modified sequence opt1 from neuraminidase__InfluenzaA__AFG99130
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgggcccaucaucaucgagcgcaacaucacggagaucgucuaccucaccaacaccaccaucgagaaggagaucugcccgaagcugguggaguaccggaacuggagcaagccccagugcaagaucacgggcuucgcgcccuucuccaaggacaacagcauccgccuguccgccgggggcgacaucugggugacccgggagcccuacgucagcugcgacccggggaagugcuaccaguucgcccucggccagggcaccacccuggacaacaagcacuccaacgacacgauccacgaccgcacccccuaccggacccugcucaugaacgagcugggggugcccuuccaccugggcacccgccaggugugcaucgccuggagcuccagcuccugccacgacgggaaggccuggcuccacgucugcgugacgggccacgacaagaacgcgaccgccagcuucaucuacgacgggcggcugguggacuccaucggcagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccgggagcgcgcagcacguggaggagugcuccugcuacccgcgcuaccccggcgugcggugcgucugccgcgacaacuggaagggcagcaaccggcccgugguggacaucaacgucaaggacuacuccaucgugagcuccuacgugugcagcgggcuggucggcgacacgccccgcaagaacgaccgguccagcuccagcuacugccgcaacccgaacaacgagaaggggaaccacggcgugaaggggugggccuucgacgacggcaacgacgucuggaugggccggaccaucuccgaggagagccgcuccggguacgagaccuucaaggugaucggcggguggagcacccccaacuccaagcuccagaccaaccgccaggugaucgucgacagcgacaaccgguccggcuacagcgggaucuucagcguggagggcaaguccugcaucaaccggugcuucuacguggagcugauccgcggccgcgagcaggagacgcgggucugguggaccagcaacuccaucgugguguucugcgggaccagcggcaccuacgggacgggcuccuggcccgacggggccgacaucaaccugaugcccaucuga

SEQ ID NO: 83007 - RNA, 1410 nt, Artificial Sequence
  derived and/or modified sequence opt1 from neuraminidase__InfluenzaA__AFG99141
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacggggcacgacaagaacgcgaccgccagcuucaucuacgacggccggcugguggacuccaucgggagcugguccaagaacauccugcgcacccaggagagcgagugcgucugcaucaacgggaccugcacgguggugaugaccgacggcuccgccagcgagcgggccgagaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccgugguggacaucaacgucaaggacuacuccaucgugagcuccuacgugugcagcggccuggucggggacacgccccgcaagaacgaccgguccagcuccagcuacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggagcacccccaacuccaagcuccagaucaaccgccaggugaucgucgacagcgacaaccgguccggguacagcggcaucuucagcguggaggggaaguccugcaucaaccggugcuucuacguggagcugauccgcggccgcgagcaggagacccgggucugguggacgagcaacuccaucgugguguucugcggcaccagcgggaccuacggcaccggguccuggcccgacggcgccgacaucaaccugaugcccaucuga

SEQ ID NO: 83008 - RNA, 1410 nt, Artificial Sequence
  derived and/or modified sequence opt1 from neuraminidase__InfluenzaA__AFG99152
augaaccccaaccagaagaucaugaccaucggcagcgugucccugaccaucgccacgaucugcuuccucaugcagaucgccauccuggucaccaccgugacccugcacuucaagcacuacgaguucagcuccccgcccaacaaccaggugaugcccugcgagcccaucaucaucgagcgcaacaucacggagaucgucuaccucaccaacaccaccaucgagaaggaggugugcccgaagcugguggaguaccggaacuggagcaagccccagugcaagaucacgggguucgcgcccuucuccaaggacaacagcauccgccuguccgccggcggggacaucugggucacccgggagcccuacgugagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggacccgccaggucugcaucgccuggagcuccagcuccugccacgacggcaaggccuggcuccacgugugcgugacggggcacgacaagaacgcgaccgccagcuucaucuacgacggccggcuggucgacuccaucgggagcugguccaagaacauccugcgcacccaggagagcgagugcgugugcaucaacgggaccugcacgguggucaugaccgacggcuccgccagcggccgggccgacaccaagauccucuucaucgaggagggcaagaucgugcacaucagcccccuguccgggagcgcgcagcacguggaggagugcuccugcuacccgcgcuaccccggcguccggugcgugugccgcgacaacuggaagggcagcaaccggcccaucguggacaucaacgucaaggacuacuccaucgugagcuccuacgugugcagcgggcuggucggcgacacgccccgcaagaacgaccgguccagcuccagcuacugccgcaacccgaacaacgagaaggggaaccacggcgugaaggggugggccuucgacgacggcaacgacgucuggaugggccggaccaucggggaggagcuccgcuccggcuacgagaccuucaaggugaucgggggcuggagcacccccaacuccaagcugcagaucaaccgccaggugaucgucgacagcgacaaccgguccggguacagcggcaucuucuccguggagggcaagagcugcaucaaccggugcuucuacguggagcugauccgcgggcgcgagcaggagacccggguccucuggacgagcaacuccaucgugguguucugcggcaccagcgggaccuacggcaccggguccuggcccgacggcgccgacaucaaccugaugcccaucuga

SEQ ID NO: 83009 - RNA, 1410 nt, Artificial Sequence; identical to SEQ ID NO: 80003
  derived and/or modified sequence opt1 from neuraminidase__InfluenzaA__AFG99163

SEQ ID NO: 83010 - RNA, 1410 nt, Artificial Sequence
  derived and/or modified sequence opt1 from neuraminidase__InfluenzaA__AFG99174
augaaccccagccagaagaucaucaccaucggcuccgugagccugaccaucgccacgaucugcuuccucaugcagaucgccauccuggucaccaccgugacccugcacuucaagcaguacgagugcuccagcccgcccaacaaccaggugaugcccugcgagcccaucaucaucgagcgcaacaucacggagaucgucuaccucaccaacaccaccaucgagaaggagaucugcccgaagcugauggaguaccggaacugguccaagccccagugcaagaucacgggguucgcgcccuucagcaaggacaacuccauccgccugagcgccggcggggacaucugggugacccgggagcccuacguguccugcgacccgggcaagugcuaccaguucgcccucgggcagggcaccacccuggacaacaagcacagcaacgacacgauccacgaccgcacccccuaccggacccugcucaugaacgagcugggcguccccuuccaccuggggacccgccaggugugcaucgccugguccagcuccagcugccacgacggcaaggccuggcuccacgugugcgucacggggcacgacaagaacgcgaccgccuccuucaucuacgacggccggcugguggacagcaucggguccuggagcaagaacauccugcgcacccaggaguccgagugcgugugcaucaacgggaccugcacggucgugaugaccgacggcagcgccagcgagcgggccgagaccaagauccucuucaucgaggaggggaagaucgugcacaucagcccccuguccggcuccgcgcagcacgucgaggagugcagcugcuacccgcgcuaccccggggugcggugcgugugccgcgacaacuggaagggcuccaaccggcccgucguggacaucaacgugaaggacuacagcaucgucuccagcuacgugugcuccggccuggugggggacacgccccgcaagaacgaccggagcuccagcuccuacugccgcaacccgaacaacgagaagggcaaccacggggucaagggcugggccuucgacgacgggaacgacguguggaugggccggaccaucagcgaggagucccgcagcggcuacgagaccuucaaggucaucgggggcugguccacccccaacagcaagcuccagaucaaccgccaggugaucguggacuccgacaaccggagcggguacagcggcaucuucuccgucgagggcaagagcugcaucaaccggugcuucuacguggagcugauccgcggccgcgagcaggagacccgggugugguggacguccaacagcaucgucguguucugcggcaccuccgggaccuacggcaccgggagcuggcccgacggcgccgacaucaaccugaugcccaucuga

SEQ ID NO: 83011 - RNA, 1410 nt, Artificial Sequence
  derived and/or modified sequence opt1 from neuraminidase__InfluenzaA__AFG99185
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacagcaagaaccgguccggcuacagcgggaucuucuccgucgagggcaagagcugcaucaaccgcugcuucuacguggagcugauccggggccgcgagcaggagacccgcgugugguggacgagcaacuccaucgucguguucugcgggaccagcggcaccuacgggaccggcuccuggcccgacggggccgacaucaaccucaugcccaucuga

SEQ ID NO: 83012 - RNA, 1410 nt, Artificial Sequence
  derived and/or modified sequence opt1 from neuraminidase__InfluenzaA__AFG99196
augaaccccaaccagaagaucaucaccaucggcagcgugucccugaccaucgccacgaucugcuuccucacccagaucgccauccuggucaccaccgugacgcugcacuucaagcaguacgagugcagcuccagcccgaacaaccaggugaugcccugcgagcccaucaucaucgagcgcaacaucaccgagaucgucuaccucaccaacaccacgaucgagaaggagaucugccccaagcugguggaguaccggaacugguccaagccgcagugcaagaucaccggguucgcgcccuucagcaaggacaacuccauccgccugagcgccggcggggacaucugggugacccgggagcccuacgucuccugcgaccccggcaagugcuaccaguucgcccucgggcagggcaccacgcugaacaacaagcacagcaacgacaccauccacgaccgcaccccguaccggacccugcucaugaacgagcugggcgugcccuuccaccuggggacgaagcaggucugcaucgccugguccagcuccagcugccacgacggcaaggccuggcuccacgugugcaucaccgggcacgacaagaacgcgaccgccuccuucaucuacgacggccgccugguggacagcaucggguccuggagcaagaacauccugcggacccaggaguccgagugcgugugcaucaacggcacgugcaccgucgugaugaccgacggcagcgccagcgagcgcgccgacaccaagauccucuucaucgaggaggggaagaucgugcacaucagcccccuguccggcuccgcgcagcacgucgaggagugcagcugcuacccccgguacccgggggugcgcugcgugugccgggacaacuggaagggcuccaaccgccccaucgucgacaucaacgugaaggacuacagcaucguguccagcuacgucugcuccggccuggugggggacacgccccggaagaacgaccgcagcuccagcuccuacugccggaaccccaacaacgagaagggcaaccacggggugaagggcugggccuucgacgacgggaacgacgucuggaugggccgcaccaucggcgaggagcuccggagcggguacgagaccuucaaggugaucggcgggugguccaccccgaacagcaagcugcagaucaaccgccaggucaucguggacuccggcaaccggagcggguacuccggcaucuucagcguggagggcaagagcugcaucaaccgcugcuucuacgucgagcugauccgggggcgcgagcaggagacgcgcgugugguggaccuccaacagcaucguggucuucugcggcaccuccgggaccuacggcacggggagcuggcccgacggcgccgacaucaaccucaugcccaucuga

SEQ ID NO: 83013 - RNA, 1410 nt, Artificial Sequence
  derived and/or modified sequence opt1 from neuraminidase__InfluenzaA__AFG99207
augaaccccaaccagaagaucaucaccaucggcagcgugucccugaccaucgccacgaucugcuuccucaugcagaucgccauccuggucaccaccgugacccugcacuucaagccguacgagugcagcuccccgcccaacaaccaggugaugcccugcgagcccaucaucaucgagcgcaacaucacggagaucgucuaccucaccaacaccaccaucgagaaggagaucugccccaagcugguggaguaccggaacuggagcaagccccagugcaagaucacgggguucgcgcccuucuccaaggacaacagcauccgccuguccgccggcggggacaucugggugacccgggagccguacgucagcugcgaccccggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccgcuguccggcagcgcgcagcacguggaggagugcuccugcuacccccgguaccccggggugcgcugcgucugccgggacaacuggaagggcagcaaccgccccaucguggacaucaacgugaaggacuacuccaucgucagcuccuacgugugcagcggccuggugggggacaccccgcggaagaacgaccgcuccagcuccagcuacugccggaaccccaacaacgagaagggcaaccacggggucaagggcugggccuucgacgacgggaacgacguguggaugggccgcacgaucggcgaggagcuccgguccggguacgagaccuucaaggucaucggcggguggagcacccccaacuccaagcugcagaucaaccgccaggugaucguggacagcaagucccggagcggcuacuccgggaucuucagcgucgagggcaagagcugcaucaaccgcugcuucuacguggagcugauccggggccgcgagcaggagacccgcgugugguggacguccaacagcaucgucguguucugcgggaccuccggcaccuacgggaccggcagcuggcccgacggggccgacaucaaccucaugccgaucuga

SEQ ID NO: 83014 - RNA, 1410 nt, Artificial Sequence; identical to SEQ ID NO: 75822
  derived and/or modified sequence opt1 from neuraminidase__InfluenzaA__AFG99218

SEQ ID NO: 83015 - RNA, 1410 nt, Artificial Sequence
  derived and/or modified sequence opt1 from neuraminidase__InfluenzaA__AFG99229
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacgaagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccugguggacuccaucgggagcugguccaagaacauccugcggacccaggagagcgagugcgucugcaucaacgggaccugcacgguggugaugaccgacggcuccgccagcgagcgcgccgacaccaagauccucuucaucgaggagggcaagaucguccacaucagcccccuguccggcagcgcgcagcacguggaggagugcuccugcuacccgcgguaccccggggugcgcugcgucugccgggacaacuggaagggcagcaaccgccccaucguggacaucaacgugaaggacuacuccaucgucagcuccuacgugugcagcggccuggugggggacacgccccggaagaacgaccgcuccagcuccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacagcaagaaccgguccggcuacagcgggaucuucuccgucgagggcaagagcugcaucaaccgcugcuucuacguggagcugauccggggccgcgagcaggagacccgcgugugguggacgagcaacuccaucgucguguucugcgggaccagcggcaccuacgggaccggcuccuggcccgacggggccgacaucaaccucaugcccaucuga

SEQ ID NO: 83016 - RNA, 1410 nt, Artificial Sequence
  derived and/or modified sequence opt1 from neuraminidase__InfluenzaA__AFG99240
augaaccccaaccagaagaucaucaccaucggcagcgugucccugaccaucgccacgaucugcuuccucaugcagaucgccauccuggucaccaccgugacccugcacuucaagcaguacgagugcagcuccccgcccagcaaccaggugaugcccugcgagcccaucaucaucgagcgcaacaucacggagaucgucuaccucaccaacaccaccaucgagaaggagaucugcccgaagcccguggaguaccggaacugguccaagccccagugcaagaucacgggguucgcgcccuucagcaaggacaacuccauccgccugagcgccggcggggacaucugggugacccgggagccguacgucuccugcgaccccggcaagugcuaccaguucgcccuggggcagggcaccacccucaacaacaagcacagcaacgacacgauccacgaccgcacccccuaccggacccugcugaugaacgagcucggcgugcccuuccaccuggggaccaagcaggucugcaucgccugguccagcuccagcugccacgacggcaaggccuggcugcacgugugcgugacggggcacgacaagaacgcgaccgccuccuucaucuacgacggccgccucguggacagcaucggguccuggagcaagaacauccugcggacccaggaguccgagugcgucugcaucaacgggaccugcacgguggugaugaccgacggcagcgccagcgagcgcgccgacaccaagauccuguucaucgaggagggcaagaucguccacaucuccccgcucagcggcuccgcgcagcacguggaggagugcagcugcuacccccgguaccccggggugcgcugcgucugccgggacaacuggaagggcuccaaccgccccaucguggacaucaacgugaaggacuacagcaucgucuccagcuacgugugcuccggccuggugggggacaccccgcggaagaacgaccgcuucagcuccagcuacugccggaaccccaacaacgagaagggcaaccacggggucaagggcugggccuucgacgacgggaacgacguguggaugggccgcacgaucggcgaggagcugcgguccggguacgagaccuucaaggucaucggcggguggagcacccccaacuccaagcuccagaucaaccgccaggugaucguggacagcaagaaccgguccggcuacagcgggaucuucuccgucgagggcaagagcugcaucaaccgcugcuucuacguggagcugauccggggccgcgagcaggagacccgcgugugguggacgagcaacuccaucgucguguucugcgggaccagcggcaccuacgggaccggcuccuggcccgacggggccgacaucaaccugaugccgaucuga

SEQ ID NO: 83017 - RNA, 1410 nt, Artificial Sequence; identical to SEQ ID NO: 75821
  derived and/or modified sequence opt1 from neuraminidase__InfluenzaA__AFG99251

SEQ ID NO: 83018 - RNA, 1410 nt, Artificial Sequence
  derived and/or modified sequence opt1 from neuraminidase__InfluenzaA__AFG99273
augaaccccaaccagaagaucaucaccaucggcagcgugucccugaccaucgccacgaugugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcgagcaggagacgcgggucugguggaccuccaacagcaucgugguguucugcggcaccuccgggaccuacggcacggggagcuggcccgacggcgccgacaucaaccucaugcccaucuga

SEQ ID NO: 83019 - RNA, 1410 nt, Artificial Sequence
  derived and/or modified sequence opt1 from neuraminidase__InfluenzaA__AFG99284
augaaccccaaccagaagaucaucaccaucggcagcgugucccugaccaucgccacgaucugcuuccucaugcagaucgccauccuggucaccaccgugacccugcacuucaagcaguacgagugcagcuccccgcccagcaaccaggugaugcccugcgagcccaucaucaucgagcgcaacaucacgaagaucgucuaccucaccaacaccaccaucgagaaggagaucugcccgaagcugguggaguaccggaacugguccaagccccagugcaagaucacgggguucgcgcccuucagcaaggacaacuccauccgccugagcgccggcggggacaucugggugacccgggagcccuacgucuccugcgacccgagcaagugcuaccaguucgcccucggccaggggaccacccugaacaacaagcacuccaacgacacgauccacgaccgcacccccuaccggacccugcucaugaacgagcugggcgugcccuuccaccugggcaccaagcaggucugcaucgccuggagcuccagcuccugccacgacgggaaggccuggcuccacgugugcgugacgggccacgacgacaacgcgaccgccagcuucaucuacgacgggcgccugguggacuccaucggcagcugguccaagaacauccugcggacccaggagagcgagugcgucugcaucaacgggaccugcacgguggugaugaccgacggcagcgccuccgagcgcgccgacaccaagauccucuucaucgaggagggcaagaucguccacaucagcccccuguccgggagcgcgcagcacguggaggagugcuccugcuacccgcgguaccccggcgugcgcugcgucugccgggacaacuggaaggggagcaaccgccccaucguggacaucaacgugaaggacuacuccaucgucagcuccuacgugugcagcggccuggugggcgacacgccccggaagaacgaccgcuccagcuccagcuacugccggaacccgaacaacgagaaggggucccacggcgucaaggggugggccuucgacgacggcaacgacguguggauggggcgcaccaucggcgaggagcuccggagcggcuacgagaccuucaaggucaucgggggcugguccacccccaacagcaagcugcagaucaaccgccaggugaucguggacuccaagaaccggagcggguacagcggcaucuucuccgucgagggcaagagcugcaucaaccgcugcuucuacguggagcugauccgggggcgcgagcaggagacccgcgugugguggacguccaacagcaucgucguguucugcggcaccuccgggaccuacggcaccgggagcuggcccgacggcgccgacaucaaccucaugcccaucuga

SEQ ID NO: 83020 - RNA, 1410 nt, Artificial Sequence
  derived and/or modified sequence opt1 from neuraminidase__InfluenzaA__AFG99295
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccggacaagugcuaccaguucgcccucggccaggggaccacgcugaacaaccgccacuccaacgacaccgugcacgaccggacccccuaccgcacccugcucaugaacgagcugggcgugcccuuccaccugggcacgaagcaggucugcaucgccuggagcuccagcuccugccacgacgggaaggccuggcuccacgugugcgugaccggccacgacaagaacgcgaccgccagcuucaucuacaacgggcggcuggucgacuccaucggcagcugguccaagaacauccugcgcacccaggagagcgagugcgugugcaucaacgggacgugcaccguggucaugaccgacggcuccgccagcgagcgggccgacaccaagauccucuucaucgaggagggcaagaucgugcacaucagcccccuguccgggagcgcgcagcacguggaggagugcuccugcuacccgcgcuaccccggcguccggugcgugugccgcgacaacuggaaggggagcaaccggcccaucguggacaucaacgucaaggacuacuccaucaucagcuccuacgugugcagcggccuggugggcgacacgccccgcaagaacgaccgguccagcuccagcuacugccagaacccgaacaacgagaaggggucccacggcgucaaggggugggccuucgacgacggcaacgacguguggauggggcgcaccaucggcgaggagcuccggagcggcuacgagaccuucaaggucaucgggggcugguccacccccaacagcaagcugcagaucaaccgccaggugaucguggacuccgggaaccggagcggcuacuccgggaucuucagcgucgagggcaagagcugcaucaaccgcugcuucuacguggagcugauccggggccgcaagcaggagacgcgcgugugguggaccuccaacagcaucgucguguucugcgggaccuccggcaccuacgggacgggcagcuggcccgacggggccgacaucaaccucaugcccaucuga

SEQ ID NO: 83021 - RNA, 1410 nt, Artificial Sequence
  derived and/or modified sequence opt1 from neuraminidase__InfluenzaA__AFG99317
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaacaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucgacgaggagcuccgcagcggcuacgagaccuucaaggugaucgggggcugguccacccccaacagcaagcugcagaucaaccgccaggugaucgucgacuccgggaaccggagcggcuacuccgggaucuucagcguggagggcaagagcugcaucaaccggugcuucuacguggagcugauccgcggccgcaagcaggagacgcgggucugguggaccuccaacagcaucgugguguucugcgggaccuccggcaccuacgggacgggcagcuggcccgacggggccgacaucaaccucaugcccaucuga

SEQ ID NO: 83022 - RNA, 1410 nt, Artificial Sequence
  derived and/or modified sequence opt1 from neuraminidase__InfluenzaA__AFG99328
augaaccccaaccagaagaucaucaccaucggcagcgugucccugacccucgccacgaucugcuuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacagcauccgccucuccgccggcggggacaucugggugacccgggagcccuacgucagcugcgacccguccaagugcuaccaguucgcccugggccaggggaccacgcugaacaaccgccacagcaacgacaccgugcacgaccggacccccuaccgcacccuccugaugaacgagcugggcgugcccuuccaccucggcacgcggcaggucugcauggccugguccagcuccagcugccacgacgggaaggccuggcugcacgugugcgugaccggccacgacgagaacgcgaccgccuccuucaucuacgacgggcgccuggucgacagcaucggcuccuggagcaagaacgugcuccggacccaggaguccgagugcgugugcaucaacgggacgugcaccgucgugaugaccgacggcagcgccagcgagcgcgccgacaccaagauccuguucaucgaggagggcaagaucgugcacaucagcccccuguccgggaacgcgcagcacgucgaggagugcuccugcuacccgcgguaccccggcgugcgcugcgugugccgggacaacuggaaggggagcaaccgccccaucgucgacaucaacgugaaggacuacuccaucgugagcuccuacgucugcagcggccucgugggcgacacgccccggaagaacgaccgcuccagcuccagcuacugccggaacccgaacaacgagaaggggucccacggcgucaaggggugggccuucgacgacggcaacgacguguggauggggcgcaccaucggcgaggagcugcggagcggcuacgagaccuucaaggugaucgggggcugguccacccccaacagcaagcugcagaucaaccgccaggucaucguggacuccgggaaccggagcggcuacuccgggaucuucagcguggagggcaagagcugcaucaaccgcugcuucuacgucgagcucauccgcggccggaagcaggagacgcgcgugugguggaccuccaacagcaucguggucuucugcgggaccuccggcaccuacgggacgggcagcuggcccgacggggccgacaucaaccugaugcccaucuga

SEQ ID NO: 83023 - RNA, 1410 nt, Artificial Sequence
  derived and/or modified sequence opt1 from neuraminidase__InfluenzaA__AFG99350
augaaccccaaccagaagaucaucaccaucggcagcgugucccugacccucgccacgaucugcuuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaccacgaucgagaaggagaucugcccgaagcugguggaguaccggaacuggagcaagccccagugcaagaucaccggguucgcgcccuucuccaaggacaacagcauccgccucuccgccggcggggacaucugggugacccgggagcccuacgucagcugcgacccguccaagugcuaccaguucgcccugggccaggggaccacgcugaacaaccgccacagcaacgacaccgugcacgaccggacccccuaccgcacccuccugaugaacgagcugggcgugcccuuccaccucggcacgcggcaggucugcauggccugguccagcuccagcugccacgacgggaaggccuggcugcacgugugcgugaccggccacgacgagaacgcgaccgccuccuucaucuacgacgggcgccuggucgacagcaucggcuccuggagcaagaacauccuccggacccaggaguccgagugcgugugcaucaacgggacgugcaccguggucaugaccgacggcagcgccagcgagcgcgccgacaccaagauccuguucaucgaggagggcaagaucgugcacaucagcccccuguccggguccgcgcagcacguggaggagugcagcugcuacccgcgguaccccggcguccgcugcgugugccgggacaacuggaagggguccaaccgccccaucguggacaucaacgucaaggacuacagcaucguguccagcuacgugugcuccggccucgucggcgacacgccccggaagaacgaccgcagcuccagcuccuacugccggaacccgaacaacgagaaggggagccacggcgugaaggggugggccuucgacgacggcaacgacgucuggauggggcgcaccaucggcgaggagcugcgguccggcuacgagaccuucaaggugaucgggggcuggagcacccccaacuccaagcugcagaucaaccgccaggugaucgucgacagcgggaaccgguccggcuacagcgggaucuucagcguggagggcaaguccugcaucaaccgcugcuucuacguggagcucauccgcggccggaagcaggagacgcgcgucugguggaccagcaacuccaucgugguguucugcgggaccagcggcaccuacgggacgggcuccuggcccgacggggccgacaucaaccugaugcccaucuga

SEQ ID NO: 83024 - RNA, 1410 nt, Artificial Sequence
  derived and/or modified sequence opt1 from neuraminidase__InfluenzaA__AFG99361
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83025 - RNA, 1410 nt, Artificial Sequence
  derived and/or modified sequence opt1 from neuraminidase__InfluenzaA__AFG99383
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgacuccagcuccagcuccuacugccggaacccgaacaacgagaagggcagccacggggugaagggcugggccuucgacgacgggaacgacgucuggaugggccgcaccaucggcgaggagcuccgguccggguacgagaccuucaaggugaucggcggguggagcacccccaacuccaagcugcagaucaaccgccaggugaucgucgacagcggcaaccgguccggguacagcggcaucuucagcguggagggcaaguccugcaucaaccgcugcuucuacguggagcugauccgggggcgcaagcaggagacgaaggucugguggaccagcaacuccaucgugguguucugcggcaccagcgggaccuacggcacgggguccuggcccgacggcgccgacaucaaccucaugcccaucuga

SEQ ID NO: 83026 - RNA, 1410 nt, Artificial Sequence; identical to SEQ ID NO: 83025
  derived and/or modified sequence opt1 from neuraminidase__InfluenzaA__AFG99394

SEQ ID NO: 83027 - RNA, 1410 nt, Artificial Sequence
  derived and/or modified sequence opt1 from neuraminidase__InfluenzaA__AFG99405
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucaucagcuccuacgugugcagcggccuggugggggacacgccccgcaagaacgaccgguccagcuccagcuacugccgcaacccgaacaacgagaagggcucccacggggucaagggcugggccuucgacgacgggaacgacguguggaugggccggaccaucggcgaggagcuccgcagcggguacgagaccuucaaggucaucggcgggugguccacccccaacagcaagcugcagaucaaccgccaggugaucguggacuccggcaaccggagcggguacuccggcaucuucagcgucgagggcaagagcugcaucaaccggugcuucuacguggagcugauccgcgggcgcgagcaggagacgcgggugugguggaccuccaacagcaucgucguguucugcggcaccuccgggaccuacggcacggggagcuggcccgacggcgccgacaucaaccucaugcccaucuga

SEQ ID NO: 83028 - RNA, 1410 nt, Artificial Sequence
  derived and/or modified sequence opt1 from neuraminidase__InfluenzaA__AFG99416
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucauccacaucagcccccuguccggcagcgcgcagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcuccuacugccggaacccgaacaacgagaagggcagccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacggcgggaaccggagcggcuacuccggcaucuucagcgucgagggcaagagcugcaucaaccgcugcuucuacguggagcugauccgggggcgcaagcaggagacgaaggugugguggaccuccaacagcaucgucguguucugcgggaccuccggcaccuacgggacgggcagcuggcccgacggcgccgacaucaaccucaugcccaucuga

SEQ ID NO: 83029 - RNA, 1410 nt, Artificial Sequence
  derived and/or modified sequence opt1 from neuraminidase__InfluenzaA__AFG99427
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggaggugugcccgaagcugguggaguaccggaacuggagcaagccccagugcaagaucaccggguucgcgcccuucuccaaggacaacagcauccgccuguccgccggcggggacaucugggucacccgggagcccuacgugagcugcgacccgggcaagugcuaccaguucgcccucgggcagggcaccacgcugaacaaccgccacuccaacgacaccgugcacgaccggacccccuaccgcacccugcucaugaacgagcugggcguccccuuccaccuggggacgaagcaggucugcaucgccuggagcuccagcuccugccacgacggcaaggccuggcuccacgugugcgugaccgggcacgacgagaacgcgaccgccagcuucaucuacgacggccggcugguggacuccaucgggagcugguccaagaacauccugcgcacccaggagagcgagugcgugugcaucaacggcacgugcaccgucgugaugaccgacggcuccgccagcgagcgggccgacaccaagauccucuucaucgaggaggggaagaucauccacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgacuccagcuccagcuccuacugccggaacccgaacaacgagaagggcagccacggggugaagggcugggccuucgacgacgggaacgacgucuggaugggccgcaccaucggcgaggagcuccgguccggguacgagaccuucaaggugaucggcggguggagcacccccaacuccaagcugcagaucaaccgccaggugaucgucgacagcggcaaccgguccggguacagcggcaucuucagcguggagggcaaguccugcaucaaccgcugcuucuacguggagcugauccgggggcgcaagcaggagacgaaggucugguggaccagcaacuccaucgugguguucugcggcaccagcgggaccuacggcacgggguccuggcccgacggcgccgacaucaaccucaugcccaucuga

SEQ ID NO: 83030 - RNA, 1410 nt, Artificial Sequence
  derived and/or modified sequence opt1 from neuraminidase__InfluenzaA__AFG99438
augaaccccaaccagaagaucaucaccaucggcagcgugucccugaccaucgccacgaucugcuuccucaugcagaucgccauccuggucaccaccgugacccugcacuuccgccaguacgagugcagcuccccgcccaacaaccaggugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacagcauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggagcuccagcuccugccacgacggcaaggccuggcuccacgugugcgugaccgggcacgacgagaacgcgaccgccagcuucaucuacgacggccgccuggucgacuccaucgggagcugguccaagaacauccugcggacccaggagagcgagugcgugugcaucaacggcacgugcaccguggucaugaccgacggcuccgccagcgagcgcgccgacaccaagauccucuucaucgaggaggggaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccuggucggggacacgccccggaagaacgaccgcuccagcuccagcuacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccgcugcuucuacguggagcugauccgcgggcggaagcaggagacgcgcgucugguggaccuccaacagcaucgugguguucugcggcaccuccgggaccuacggcacggggagcuggcccgacggcgccgacaucaaccucaugcccaucuga

SEQ ID NO: 83031 - RNA, 1410 nt, Artificial Sequence
  derived and/or modified sequence opt1 from neuraminidase__InfluenzaA__AFG99449
augaaccccaaccagaagaucaucaccaucggcagcgugucccugaccaucgccacgaucugcuuccucaugcagaucgccauccuggucaccaccgugacccugcacuuccgccaguacgagugcagcuccccgcccaacaaccaggugaugcccugcgagcccacgaucaucgagcggaacaucaccgagaucgucuaccucaccaacaccacgaucgagaaggagaucugcccgaagcugguggaguaccgcaacuggagcaagccccagugcaagaucaccggguucgcgcccuucuccaaggacaacagcauccggcuguccgccggcggggacaucugggugacccgcgagcccuacgucagcugcgacccgggcaagugcuaccaguucgcccucgggcagggcaccacgcugaacaaccggcacuccaacgacaccgugcacgaccgcacccccuaccggacccugcucaugaacgagcugggcgugcccuuccaccuggggacgaagcaggucugcauggccuggagcuccagcuccugccacgacggcaaggccuggcuccacgugugcgugaccgggcacgacgagaacgcgaccgccagcuucaucuacgacggccgccuggucgacuccaucgggagcugguccaagaacauccugcggacccaggagagcgagugcgugugcaucaacggcacgugcaccguggucaugaccgacggcuccgccagcgagcgcgccgacaccaagauccucuucaucgaggaggggaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccuggucggggacacgccccggaagaacgaccgcuccagcuccagcuacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacagcaagcugcagaucaaccgccaggugaucgucgacuccggcaaccggagcggguacuccggcaucuucagcguggagggcaagaacugcaucaaccgcugcuucuacguggagcugauccgcgggcggaagcaggagacgcgcgucugguggaccagcaacuccaucgugguguucugcggcaccagcgggaccuacggcacgggguccuggcccgacggcgccgacaucaaccucaugcccaucuga

SEQ ID NO: 83032 - RNA, 1410 nt, Artificial Sequence
  derived and/or modified sequence opt1 from neuraminidase__InfluenzaA__AFG99471
augaaccccaaccagaagaucaucaccaucggcagcgugucccugauccucgccaccaucugcuuccugaugcagaucgccauccuggucacgaccgugacccuccacuucaagcaguacgagugcagcuccccgcccaacaaccaggugaugcccugcgagcccaccaucaucgagcgcaacaucacggagaucgucuaccugaccaacaccaccaucgagaaggagaucugcccgaagcugguggaguaccggaacuggagcaagccccagugcaagaucacgggguucgcgcccuucuccaaggacaacagcauccgccucuccgccggcggggacaucugggugacccgggagcccuacgucagcugcgacccgggcaagugcuaccaguucgcccuggggcagggcaccacccugaacaaccgccacuccaacgacacggugcacgaccggaaccccuaccgcacccuccugaugaacgagcugggcgugcccuuccaccucgggacccggcaggucugcauggccuggagcuccagcuccugccacgacggcaaggccuggcugcacgugugcgugaccgggcacgacgagaacgcgacggccagcuucaucuacgacggccgccuggucgacuccaucgggagcugguccaagaacauccuccggacccaggagagcgagugcgugugcaucaacgggaccugcaccguggucaugacggacggcuccgccagcgagcgcgccgacaccaagauccuguucaucgaggagggcaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccucgucggggacacgccccggaagaacgaccgcuccagcuccagcuacugccggaacccgaacaacgagaagggcucccacggggugaagggcugggccuucgacgacgggaacgacgucuggaugggccgcaccaucggcgaggagcugcggagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccgcugcuucuacguggagcucauccgcgggcggaagcaggagacccgcgucugguggaccuccaacagcaucgugguguucugcggcacguccgggaccuacggcaccgggagcuggcccgacggcgccgacaucaaccugaugcccaucuga

SEQ ID NO: 83033 - RNA, 1410 nt, Artificial Sequence
  derived and/or modified sequence opt1 from neuraminidase__InfluenzaA__AFG99482
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucggguccuggagcaagaacauccugcgcacccaggaguccgagugcgugugcaucaacggcacgugcaccguggucaugaccgacggcagcgccuccgggcgggccgacaccaagauccucuucaucgaggagggcaagaucgugcacaucagcccccugagcggguccgcgcagcacguggaggagugcagcugcuacccgcgcuaccccggcguccggugcgugugccgcgacaacuggaagggcuccaaccggcccaucguggacaucaacgucaaggacuacagcaucguguccagcuacgugugcuccgggcuggucggcgacacgccccgcaagaacgacagcuccagcuccagcuacugccggaacccgaacaacgagaaggggucccacggcgugaaggggugggccuucgacgacggcaacgacgucuggaugggccgcaccaucggggaggagcuccggagcggcuacgagaccuucaaggugaucgggggcugguccacccccaacagcaagcugcagaucaaccgccaggugaucgucgaccgggggaaccgcuccggcuacagcggcaucuucuccguggaggggaagaacugcaucaaccggugcuucuacguggagcugauccgcggccgcaagcaggagacgaaggucugguggaccagcaacagcaucgugguguucugcgggaccuccggcaccuacgggacgggcagcuggcccgacggcgccgacaucaaccucauguccaucuga

SEQ ID NO: 83034 - RNA, 1410 nt, Artificial Sequence
  derived and/or modified sequence opt1 from neuraminidase__InfluenzaA__AFG99493
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucggguccuggagcaagaacauccugcgcacccaggaguccgagugcgugugcaucaacggcacgugcaccguggucaugaccgacggcagcgccuccgggcgggccgacaccaagauccucuucaucgaggagggcaagaucgugcacaucagcccccugagcggguccgcgcagcacguggaggagugcagcugcuacccgcgcuaccccggcguccggugcgugugccgcgacaacuggaagggcuccaaccggcccaucguggacaucaacgucaaggacuacagcaucguguccagcuacgugugcuccgggcuggucggcgacacgccccgcaagaacgacagcuccagcuccagcuacugccggaacccgaacaacgagaaggggucccacggcgugaaggggugggccuucgacgacggcaacgacgucuggaugggccgcaccaucggggaggagcuccggagcggcuacgagaccuucaaggugaucgggggcugguccacccccaacagcaagcugcagaucaaccgccaggugaucgucgaccgggggaaccgcuccggcuacagcggcaucuucuccguggagggcaagagcugcaucaaccggugcuucuacguggagcugauccgcgggcgcaagcaggagacgaaggucugguggaccagcaacuccaucgugguguucugcgggaccagcggcaccuacgggacgggcuccuggcccgacggcgccgacaucaaccucaugcccaucuga

SEQ ID NO: 83035 - RNA, 1410 nt, Artificial Sequence
  derived and/or modified sequence opt1 from neuraminidase__InfluenzaA__AFG99504
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcaagcaggagacgcgggucugguggaccuccaacagcaucgugguguucugcggcaccuccgggaccuacggcacggggagcuggcccgacggcgccgacaucaaccucaugcccaucuga

SEQ ID NO: 83036 - RNA, 1410 nt, Artificial Sequence
  derived and/or modified sequence opt1 from neuraminidase__InfluenzaA__AFG99515
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucggcgaggagcugcggagcggguacgagaccuucaaggucaucggcgggugguccaccccgaacagcaagcugcagaucaaccgccaggugaucguggaccggggcaaccgcuccggguacagcggcaucuucuccgucgagggcaagagcugcaucaaccggugcuucuacguggagcucauccgcgggcgcaagcaggagacggaggugugguggaccagcaacuccaucgucguguucugcggcaccagcgggaccuacggcacgggguccuggcccgacggcgccgacaucaaccugaugcccaucuga

SEQ ID NO: 83037 - RNA, 1410 nt, Artificial Sequence
  derived and/or modified sequence opt1 from neuraminidase__InfluenzaA__AFG99526
augaaccccaaccagaagaucaucaccaucggcagcgugucccugacccucgccacgaucugcuuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaccacgaucgagaaggaggugugcccgaagcugguggaguaccggaacuggagcaagccccagugcaagaucaccggguucgcgcccuucuccaaggacaacagcauccgccucuccgccggcggggacaucugggucacccgggagcccuacgugagcugcgacccgggcaagugcuaccaguucgcccuggggcagggcaccacgcugaacaaccgccacuccaacgacaccgugcacgaccggacccccuaccgcacccuccugaugaacgagcugggcguccccuuccaccucgggacgcgccaggugugcauggccuggagcuccagcuccugccacgacggcaaggccuggcugcacgugugcgucaccgggcacgacgagaacgcgaccgccagcuucaucuacgacggccggcugguggacuccaucgggagcugguccaagaacauccuccggacccaggagagcgagugcgugugcaucaacggcacgugcaccgucgugaugaccgacggcuccgccagcgggcgcgccgacaccaagauccuguucaucgaggagggcaagaucgugcacaucagcccccuguccgggagcgcgcagcacgucgaggagugcuccugcuacccgcgguaccccggcgugcgcugcgugugccgggacaacuggaagggcagcaaccgccccaucgucgacaucaacgugaaggacuacuccaucgugagcuccuacgucugcagcgggcucgugggcgacacgccccggaagaacgaccgcuccagcuccagcuacugccggaacccgaacaacgagaaggggucccacggcgucaaggggugggccuucgacgacggcaacgacguguggaugggccgcaccaucggggaggagcugcggagcggcuacgagaccuucaaggugaucgggggcugguccacccccaacagcaagcugcagaucaaccgccaggucaucguggacuccgggaaccggagcggcuacuccggcaucuucagcguggagggcaagagcugcaucaaccgcugcuucuacgucgagcucauccgcgggcggaagcaggagacgcgcgugugguggaccuccaacagcaucguggucuucugcgggaccuccggcaccuacgggacgggcagcuggcccgacggcgccgacaucaaccugaugcccaucuga

SEQ ID NO: 83038 - RNA, 1410 nt, Artificial Sequence; identical to SEQ ID NO: 82934
  derived and/or modified sequence opt1 from neuraminidase__InfluenzaA__AFG99537

SEQ ID NO: 83039 - RNA, 1410 nt, Artificial Sequence; identical to SEQ ID NO: 82934
  derived and/or modified sequence opt1 from neuraminidase__InfluenzaA__AFG99548

SEQ ID NO: 83040 - RNA, 1410 nt, Artificial Sequence; identical to SEQ ID NO: 82934
  derived and/or modified sequence opt1 from neuraminidase__InfluenzaA__AFG99559

SEQ ID NO: 83041 - RNA, 1410 nt, Artificial Sequence; identical to SEQ ID NO: 82934
  derived and/or modified sequence opt1 from neuraminidase__InfluenzaA__AFG99570

SEQ ID NO: 83042 - RNA, 1410 nt, Artificial Sequence; identical to SEQ ID NO: 82934
  derived and/or modified sequence opt1 from neuraminidase__InfluenzaA__AFG99581

SEQ ID NO: 83043 - RNA, 1410 nt, Artificial Sequence
  derived and/or modified sequence opt1 from neuraminidase__InfluenzaA__AFG99592
augaaccccaaccagaagaucaucaccaucggcagcgugucccugaccaucgccacgaccugcuuccucaugcagaucgccauccuggucaccaccgugacgcugcacuucaagcaguacgagugcaacagcccgcccaacaaccaggugaugcccugcgagcccaccaucaucgagcgcaacaucaccgagaucgucuaccucaccaacacgaccaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcacgacccugaacaaccgccacagcaacgacaccgugcacgaccggacccccuaccgcacgcugcucaugaacgagcugggcgugcccuuccaccuggggaccaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacauccugcgcacgcaggaguccgagugcgugugcaucaacgggaccugcaccgucgugaugaccgacggcagcgccuccgagcgggccgacacgaagauccucuucaucgaggagggcaagaucgugcacaucagcccccugagcggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacagcaagcugcagaccaaccgccaggucaucguggaccgggggaaccgcuccggcuacagcgggaucuucuccguggagggcaagagcugcaucaaccggugcuucuacgucgagcugauccgcggccgcaagcaggagaccaaggugugguggaccagcaacuccaucguggucuucugcgggacgagcggcaccuacgggaccggcuccuggcccgacggggccgacaucaaccucaugcccaucuga

SEQ ID NO: 83044 - RNA, 1410 nt, Artificial Sequence; identical to SEQ ID NO: 82934
  derived and/or modified sequence opt1 from neuraminidase__InfluenzaA__AFG99603

SEQ ID NO: 83045 - RNA, 1410 nt, Artificial Sequence; identical to SEQ ID NO: 82934
  derived and/or modified sequence opt1 from neuraminidase__InfluenzaA__AFG99614

SEQ ID NO: 83046 - RNA, 1410 nt, Artificial Sequence; identical to SEQ ID NO: 82934
  derived and/or modified sequence opt1 from neuraminidase__InfluenzaA__AFG99625

SEQ ID NO: 83047 - RNA, 1410 nt, Artificial Sequence
  derived and/or modified sequence opt1 from neuraminidase__InfluenzaA__AFG99636
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucgucuccuggagcaagaacauccuccgcacccaggaguccgagugcgugugcaucaacgggacgugcaccguggucaugaccgacggcagcgccuccgagcgggcggacaccaagauccuguucaucgaggagggcaagaucgugcacaucagcccccugagcggguccgcccagcacguggaggagugcagcugcuacccccgcuacccgggcguccggugcgugugccgcgacaacuggaagggguccaaccggcccaucguggacaucaacgucaaggacuacagcaucguguccagcuacgugugcuccggccucgucggcgacacgccccgcaagaacgacagcuccagcuccagcuacugccggaaccccaacaacgagaaggggucccacggcgugaaggggugggccuucgacgacggcaacgacgucuggauggggcgcaccaucggcgaggaccugcggagcggcuacgagaccuucaaggugaucgggggcugguccaccccgaacagcaagcugcagacgaaccgccaggugaucgucgaccgggggaaccgcuccggcuacagcgggaucuucuccguggagggcaagagcugcaucaaccggugcuucuacguggagcucauccgcggccgcaagcaggagaccaaggucugguggaccagcaacuccaucgugguguucugcgggaccagcggcacguacgggaccggcuccuggcccgacggggccgacaucaaccugaugcccaucuga

SEQ ID NO: 83048 - RNA, 1410 nt, Artificial Sequence
  derived and/or modified sequence opt1 from neuraminidase__InfluenzaA__AFG99658
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucagcaaggacaacuccauccgccucagcgcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccagcuccagcugccacgacggcaaggccuggcugcacgugugcgugaccgggcacgacgagaacgccaccgcguccuucaucuacgacggccggcuggucgacagcaucuccagcugguccaagaacauccuccgcacgcaggagagcgagugcgugugcaucaacgggaccugcaccguggucaugaccgacggcuccgccagcgagcgggccgacacgaagauccuguucaucgaggagggcaagaucgugcacaucagcccccuguccgggagcgcccagcacguggaggagugcuccugcuacccccgcuacccgggcguccggugcgugugccgcgacaacuggaaggggagcaaccggcccaucguggacaucaacgucaaggacuacuccaucgugagcuccuacgugugcagcggccucgucggcgacacgccccgcaagaacgacuccagcuccagcuccuacugccggaaccccaacaacgagaaggggagccacggcgugaaggggugggcguucgacgacggcaacgacgucuggauggggcgcaccaucuccgaggagcugcggagcggcuacgagaccuucaaggugaucggcgggugguccaccccgaacagcaagcugcagaucaaccgccaggugaucgucgaccggggcaaccgcuccggguacagcggcaucuucagcguggaggggaaguccugcaucaaccggugcuucuacguggagcucauccgcggccgcaagcaggagaacaaggucugguggaccagcaacuccaucgugguguucugcggcaccagcgggaccuacggcacgggguccuggcccgacggcgccgacaucaaccugaugcccaucuga

SEQ ID NO: 83049 - RNA, 1410 nt, Artificial Sequence
  derived and/or modified sequence opt1 from neuraminidase__InfluenzaA__AFG99680
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugauccucugccagcccacgaucaucgagcgcaacaucaccgagaucgucuaccugaccaacaccacgaucgagaaggagaucugccccaagcugguggaguaccggaacuggagcaagccgcagugcaagaucaccggguucgcgcccuucuccaaggacaacagcauccgccucuccgccggcggggacaucugggugacccgggagcccuacgucagcugcgaccccuccaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccagcuccagcugccacgacgggaaggccuggcugcacgugugcgugaccggccacgacgagaacgcgaccgccuccuucaucuacgacgggcggcuggucgacagcaucggcuccuggagcaagaacauccuccgcacccaggaguccgagugcgugugcaucaacgggacgugcaccguggucaugaccgacggcagcgccagcgagcgggccgacaccaagauccuguucaucgaggagggcaagguggugcacaucagcccccuguccggguccgcgcagcacgucgaggagugcagcugcuacccccgcuacccgggcgugcggugcgugugccgcgacaacuggaagggguccaaccggcccaucgucgacaucaacgugaaggacuacagcaucguguccagcuacgucugcuccggccucgugggcgacacgccccgcaagaacgacagcuccagcuccagcuacugccggaaccccaacaacgagaaggggucccacggcgucaaggggugggccuucgacgacggcaacgacguguggauggggcgcaccaucagcgaggagcugcgguccggcuacgagaccuucaaggugaucggcggguggagcaccccgaacuccaagcugcagaucaaccgccaggucaucguggacagcggcaaccggagcggguacuccggcaucuucagcguggaggggaaguccugcaucaaccgcugcuucuacgucgagcucauccggggccgcaagcaggagacgaaggugugguggaccagcaacuccaucguggucuucugcggcaccagcgggaccuacggcacgggguccuggcccgacggcgccgacaucaaccugaugcccaucuga

SEQ ID NO: 83050 - RNA, 1410 nt, Artificial Sequence
  derived and/or modified sequence opt1 from neuraminidase__InfluenzaA__AFG99691
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaccaccgagaucgucuaccucaccaacacgaccaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcacgacccugaacaaccgccacagcaacgacaccgugcacgaccggacccccuaccgcacgcugcucaugaacgagcugggcgugcccuuccaccuggggaccaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacauccugcgcacgcaggaguccgagugcgugugcaucaacgggaccugcaccgucgugaugaccgacggcagcgccuccgagcgggccgacacgaagauccucuucaucgaggagggcaagaucgugcacaucagcccccugagcggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacagcaagcugcagaccaaccgccaggucaucguggaccgggggaaccgcuccggcuacagcgggaucuucuccguggagggcaagagcugcaucaaccggugcuucuacgucgagcugauccgcggccgcaagcaggagaccaaggugugguggaccagcaacuccaucguggucuucugcgggacgagcggcaccuacgggaccggcuccuggcccgacggggccgacaucaaccucaugcccaucuga

SEQ ID NO: 83051 - RNA, 1410 nt, Artificial Sequence; identical to SEQ ID NO: 82934
  derived and/or modified sequence opt1 from neuraminidase__InfluenzaA__AFG99704

SEQ ID NO: 83052 - RNA, 1410 nt, Artificial Sequence; identical to SEQ ID NO: 82934
  derived and/or modified sequence opt1 from neuraminidase__InfluenzaA__AFG99715

SEQ ID NO: 83053 - RNA, 1410 nt, Artificial Sequence; identical to SEQ ID NO: 82934
  derived and/or modified sequence opt1 from neuraminidase__InfluenzaA__AFG99726

SEQ ID NO: 83054 - RNA, 1410 nt, Artificial Sequence
  derived and/or modified sequence opt1 from neuraminidase__InfluenzaA__AFG99737
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucagcaaggacaacuccauccgccucagcgcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccagcuccagcugccacgacggcaaggccuggcugcacgugugcgugaccgggcacgacgagaacgccaccgcguccuucaucuacgacggccggcuggucgacagcaucggguccuggagcaagaacauccuccgcacgcaggaguccgagugcgugugcaucaacgggaccugcaccguggucaugaccgacggcagcgccuccgagcgggccgacacgaagauccuguucaucgaggagggcaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggcguucgacgacgggaacgacgucuggaugggccgcaccaucagcgaggagcugcgguccggcuacgagaccuucaaggugaucgggggcuggagcaccccgaacuccaagcugcagaucaaccgccaggugaucgucgaccgggggaaccgcagcggcuacuccgggaucuucagcguggagggcaagagcugcaucaaccggugcuucuacguggagcucauccgcggccgcaagcaggagaacaaggucugguggaccuccaacagcaucgugguguucugcgggaccuccggcaccuacgggacgggcagcuggcccgacggggccgacaucaaccugaugcccaucuga

SEQ ID NO: 83055 - RNA, 1410 nt, Artificial Sequence
  derived and/or modified sequence opt1 from neuraminidase__InfluenzaA__AFG99748
augaaccccaaccagaagaucaucaccaucggcagcgugucccugaccaucgccacgaucugcuuccucaugcagaucgccauccuggucaccaccgugacccugcacuucaagcaguacgacugcaacagcccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgcgugguccagcuccagcugccacgacggcaaggccuggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgcguccgagcgggccgacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugccggaaccccaacaacgagaagggcucccacggggugaagggcugggccuucgacgacgggaacgacgucuggaugggccgcaccaucggcgaggagcugcggagcggguacgagaccuucaaggugaucggcgggugguccaccccgaacagcaagcugcagaucaaccgccaggucaucguggaccggggcaaccgcuccggguacagcggcaucuucuccguggagggcaagagcugcacgaaccggugcuucuacgucgagcucauccgcgggcgcaagcaggagaccgaggugugguggaccagcaacuccaucguggucuucugcggcaccagcgggacguacggcaccggguccuggcccgacggcgccgacaucaaccugaugcccaucuga

SEQ ID NO: 83056 - RNA, 1410 nt, Artificial Sequence; identical to SEQ ID NO: 82934
  derived and/or modified sequence opt1 from neuraminidase__InfluenzaA__AFG99759

SEQ ID NO: 83057 - RNA, 1410 nt, Artificial Sequence
  derived and/or modified sequence opt1 from neuraminidase__InfluenzaA__AFG99770
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccagaucaugcucugcgagcccacgaucaucgagcgcaacaucaccgagaucguguaccugaccaacaccacgaucgagcgggagaucugccccaagcuggucgaguaccgcaacugguccaagccgcagugcaagaucaccggguucgcgcccuucagcaaggacaacuccauccggcucagcgccggcggggacaucugggugacccgcgagcccuacguguccugcgaccccggcaagugcuaccaguucgcccuggggcagggcaccacgcugaacaaccggcacagcaacgacaccguccacgaccgcaccccguaccggacccuccugaugaacgagcugggcgugcccuuccaccucgggacgaagcaggucugcaucgccugguccagcuccagcugccacgacggcaaggccuggcugcacgugugcgugaccgggcacgacgagaacgcgaccgccuccuucaucuacgacggccgccugguggacagcaucggguccuggagcaagaacauccuccggacccaggaguccgagugcgucugcaucaacggcacgugcaccguggugaugaccgacggcagcgccuccgagcgcgccgacaccaagauccuguucaucgaggaggggaagaucguccacaucagcccccugagcggcuccgcgcagcacguggaggagugcagcugcuacccccgguacccgggggugcgcugcgucugccgggacaacuggaagggcuccaaccgccccaucguggacaucaacgugaaggacuacagcaucgucuccagcuacgugugcuccggccucgugggggacacgccccggaagaacgacagcuccagcuccagcuacugccgcaaccccaacaacgagaagggcucccacggggucaagggcugggccuucgacgacgggaacgacguguggaugggccggaccaucggcgaggagcugcgcagcggguacgagaccuucaaggucaucggcgggugguccaccccgaacagcaagcugcagaucaaccgccaggugaucguggaccggggcaaccgguccggguacagcggcaucuucuccgucgagggcaagagcugcaucaaccgcugcuucuacguggagcucauccgcgggcggaagcaggagacggaggugugguggaccagcaacuccaucgucguguucugcggcaccagcgggaccuacggcacgggguccuggcccgacggcgccgacaucaaccugaugcccaucuga

SEQ ID NO: 83058 - RNA, 1410 nt, Artificial Sequence
  derived and/or modified sequence opt1 from neuraminidase__InfluenzaA__AFG99781
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcucugccagcccacgaucaucgagcgcaacaucaccgagaucgucuaccugaccaacaccacgaucgagaaggagaucugccccaagcugguggaguaccggaacuggagcaagccgcagugcaagaucaccggguucgcgcccuucuccaaggacaacagcauccgccucuccgccggcggggacaucugggugacccgggagcccuacgucagcugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcaucgccuggagcuccagcuccugccacgacggcaaggccuggcugcacgugugcgugaccgggcacgacgagaacgcgaccgccagcuucaucuacgacggccggcuggucgacuccaucgggagcugguccaagaacauccuccgcacccaggagagcgagugcgugugcaucaacggcacgugcaccguggucaugaccgacggcuccgccagcaagcgggccgacaccaagauccuguucaucgaggaggggaagaucgugcacaucagcccccuguccggcagcgcgcagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaccccgaacagcaagcugcagacgaaccgccaggugaucgucgacuccgggaaccggagcggcuacagcgggaucuucuccguggagggcaagagcugcaucaaccgcugcuucuacguggagcucauccggggccgcaagcaggagaccaaggucugguggaccuccaacagcaucgugguguucugcgggaccuccggcacguacgggaccggcagcuggcccgacggggccgacaucaaccugaugcccaucuga

SEQ ID NO: 83059 - RNA, 1410 nt, Artificial Sequence; identical to SEQ ID NO: 82934
  derived and/or modified sequence opt1 from neuraminidase__InfluenzaA__AFG99792

SEQ ID NO: 83060 - RNA, 1410 nt, Artificial Sequence; identical to SEQ ID NO: 83054
  derived and/or modified sequence opt1 from neuraminidase__InfluenzaA__AFG99803

SEQ ID NO: 83061 - RNA, 1410 nt, Artificial Sequence; identical to SEQ ID NO: 82934
  derived and/or modified sequence opt1 from neuraminidase__InfluenzaA__AFG99825

SEQ ID NO: 83062 - RNA, 1410 nt, Artificial Sequence; identical to SEQ ID NO: 82934
  derived and/or modified sequence opt1 from neuraminidase__InfluenzaA__AFG99836

SEQ ID NO: 83063 - RNA, 1410 nt, Artificial Sequence; identical to SEQ ID NO: 82934
  derived and/or modified sequence opt1 from neuraminidase__InfluenzaA__AFG99847

SEQ ID NO: 83064 - RNA, 1410 nt, Artificial Sequence; identical to SEQ ID NO: 82934
  derived and/or modified sequence opt1 from neuraminidase__InfluenzaA__AFG99858

SEQ ID NO: 83065 - RNA, 1410 nt, Artificial Sequence; identical to SEQ ID NO: 82934
  derived and/or modified sequence opt1 from neuraminidase__InfluenzaA__AFG99869

SEQ ID NO: 83066 - RNA, 1410 nt, Artificial Sequence; identical to SEQ ID NO: 82934
  derived and/or modified sequence opt1 from neuraminidase__InfluenzaA__AFG99880

SEQ ID NO: 83067 - RNA, 1410 nt, Artificial Sequence
  derived and/or modified sequence opt1 from neuraminidase__InfluenzaA__AFG99891
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuacuucaccaacaccacgaucgagaaggagaucugccccaagcuggcggaguaccggaacugguccaagccgcagugcaagaucaccggguucgcccccuucagcaaggacaacuccauccgccugagcgccggcggggacaucugggugacccgggagcccuacguguccugcgaccccggcaagugcuaccaguucgcccucgggcagggcaccacgcugaacaaccgccacagcaacgacaccguccacgaccggaccccguaccgcacccugcucaugaacgagcugggcgugcccuuccaccuggggacgaagcaggucugcaucgccugguccagcuccagcugccacgacggcaaggcguggcuccacgugugcgugaccgggcacgacgagaacgccaccgccuccuucaucuacgacggccggcugguggacagcaucggguccuggagcaagaacauccugcgcacccaggaguccgagugcgucugcaucaacggcacgugcaccguggugaugaccgacggcagcgccuccgagcgggcggacaccaagauccucuucaucgaggaggggaagaucguccacaucagcagccuguccggcagcgcccagcacguggaggagugcuccugcuacccccgcuaccccggggugcggugcgucugccgcgacaacuggaagggcagcaaccggccgaucguggacaucaacgugaaggacuacuccaucgucagcuccuacgugugcagcggccuggugggggacacgccccgcaagaacgacuccagcuccagcuccuacugccggaaccccaacaacgagaagggcagccacggggucaagggcugggccuucgacgacgggaacgacguguggaugggccgcaccaucggcgaggagcuccgguccggguacgagaccuuccgcgucaucggcggguggagcacccccaacuccaagcugcagaucaaccgccaggugaucguggaccggggcaaccggagcggguacuccggcaucuucagcgucgagggcaagagcugcaucaaccgcugcuucuacguggagcugauccgcgggcggaagcaggagacggaggugugguggaccuccaacagcaucgucguguucugcggcaccuccgggaccuacggcacggggagcuggccggacggcgccgacaucaaccucaugcccaucuga

SEQ ID NO: 83068 - RNA, 1410 nt, Artificial Sequence; identical to SEQ ID NO: 82934
  derived and/or modified sequence opt1 from neuraminidase__InfluenzaA__AFG99902

SEQ ID NO: 83069 - RNA, 1410 nt, Artificial Sequence; identical to SEQ ID NO: 82934
  derived and/or modified sequence opt1 from neuraminidase__InfluenzaA__AFG99913

SEQ ID NO: 83070 - RNA, 1410 nt, Artificial Sequence; identical to SEQ ID NO: 82934
  derived and/or modified sequence opt1 from neuraminidase__InfluenzaA__AFG99924

SEQ ID NO: 83071 - RNA, 1410 nt, Artificial Sequence
  derived and/or modified sequence opt1 from neuraminidase__InfluenzaA__AFG99935
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucgucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccagcaagugcuaccaguucgcccugggccaggggaccacgcugaacaaccgccacuccaacgacaccgugcacgaccggaccccguaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcuggucgacuccaucggcagcugguccaagaacauccuccgcacccaggagagcgagugcgugugcaucaacgggacgugcaccguggucaugaccgacggcuccgccagcgagcgggcggacaccaagauccuguucaucgaggagggcaagaucgugcacaucagcccccuguccgggagcgcccagcacguggaggagugcuccugcuacccccgcuacccgggcguccggugcgugugccgcgacaacuggaaggggagcaaccggcccaucguggacaucaacaugaaggacuacuccaucgucagcuccuacgugugcagcggccucgugggcgacacgccccgcaacaacgacuccagcuccagcuccuacugccggaaccccaacaacgagaaggggagccacggcgucaaggggugggccuucgacgacggcaacgacguguggauggggcgcaccaucggcgaggagcugcgguccggcuacgagaccuucaaggucaucgggggcuggagcaccccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagacggaggugugguggaccuccaacagcaucgucguguucugcgggaccuccggcaccuacgggacgggcagcuggcccgacggggccgacaucaaccugaugcccaucuga

SEQ ID NO: 83072 - RNA, 1410 nt, Artificial Sequence; identical to SEQ ID NO: 82934
  derived and/or modified sequence opt1 from neuraminidase__InfluenzaA__AFG99946

SEQ ID NO: 83073 - RNA, 1410 nt, Artificial Sequence
  derived and/or modified sequence opt1 from neuraminidase__InfluenzaA__AFG99957
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgcgugguccagcuccagcugccacgacggcaaggccuggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgcguccgagcgggccgacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugccggaaccccaacaacgagaagggcucccacggggugaagggcugggccuucgacgacgggaacgacgucuggaugggccgcaccaucggcgaggagcugcggagcggguacgagaccuucaaggugaucggcgggugguccaccccgaacagcaagcugcagaucaaccgccaggucaucguggaccggggcaaccgcuccggguacagcggcaucuucuccguggagggcaagagcugcacgaaccggugcuucuacgucgagcucauccgcgggcgcaagcaggagaccgaggugugguggaccagcaacuccaucguggucuucugcggcaccagcgggacguacggcaccggguccuggcccgacggcgccgacaucaaccugaugcccaucuga

SEQ ID NO: 83074 - RNA, 1410 nt, Artificial Sequence; identical to SEQ ID NO: 82934
  derived and/or modified sequence opt1 from neuraminidase__InfluenzaA__AFG99968

SEQ ID NO: 83075 - RNA, 1410 nt, Artificial Sequence
  derived and/or modified sequence opt1 from neuraminidase__InfluenzaA__AFG99979
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucguguccuggagcaagaacauccugcgcacccaggaguccgagugcgugugcaucaacgggacgugcaccgucgugaugaccgacggcagcgccuccgagcgggccgacaccaagauccucuucaucgaggagggcaagaucgugcacaucagcccccugagcggguccgcgcagcacgucgaggagugcagcugcuacccgcgcuaccccggcgugcggugcgugugccgcgacaacuggaagggguccaaccggcccaucgucgacaucaacgugaaggacuacagcaucguguccagcuacgucugcuccggccuggugggcgacacgccccgcaagaacgacagcuccagcuccagcuacugccucaacccgaacaacgagaaggggucccacggcgucaaggggugggccuucgacgacggcaacgacguguggauggggcggaccaucggcgaggagcugcgcagcggcuacgagaccuucaaggugaucgggggcugguccacccccaacagcaagcugcagacgaaccggcaggucaucguggaccgcgggaaccgguccggcuacagcgggaucuucuccguggagagcaagagcugcaucaaccgcugcuucuacgucgagcucauccggggccgcaagcaggagaccaaggugugguggaccuccaacagcaucguggucuucugcggcaccuccgggacguacggcaccgggagcuggcccgacggcgccgacaucaaccugaugcccaucuga

SEQ ID NO: 83076 - RNA, 1410 nt, Artificial Sequence
  derived and/or modified sequence opt1 from neuraminidase__InfluenzaA__AFG99990
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggcgaugcucugcgagcccaagaucaucgagcgcaacaucacggagaucguguaccugaccaacaccaccaucgagaaggagaucugccccaagcuggccgaguaccggaacugguccaagccgcagugcaagaucacgggguucgcccccuucagcaaggacaacuccauccgccucagcgccggcggggacaucugggucacccgggagcccuacguguccugcgaccccggcaagugcuaccaguucgcccuggggcagggcaccacccugaacaaccgccacagcaacgacacggugcacgaccggaccccguaccgcacccuccugaugaacgagcugggcguccccuuccaccucgggaccaagcaggucugcaucgcgugguccagcuccagcugccacgacggcaaggccuggcugcacgugugcgugacggggcacgacgagaacgccaccgccuccuucaucuacgacggccggcugguggacagcaucggguccuggagcaagaacauccuccgcacccaggaguccgagugcgugugcaucaacgggaccugcacggucgugaugaccgacggcagcgcguccgagcgggccgacaccaagauccuguucaucgaggagggcaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggucaucguggaccgggggaaccgcagcggcuacuccgggaucuucagcguggagggcaagagcugcaucaaccggugcuucuacgucgagcucauccgcggccgcaagcaggagaccgaggugugguggaccuccaacagcaucguggucuucugcgggacguccggcaccuacgggaccggcagcuggcccgacggggccgacaucaaccugaugcccaucuga

SEQ ID NO: 83077 - RNA, 1410 nt, Artificial Sequence
  derived and/or modified sequence opt1 from neuraminidase__InfluenzaA__AFH00002
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcgccguggucaugaccgacggcuccgccagcgagcgggcggacaccaagauccucuucaucgaggaggggaagguggugcacaucagcccccuguccggcagcgcccagcacgucgaggagugcuccugcuacccgcgcuaccccggggugcggugcgugugccgcgacaacuggaagggcagcaaccggcccaucgucgacaucaacgugaagaacuacuccaucgugagcuccuacgucugcagcggccuggugggggacacgccccgcaagaacgacuccagcuccagcuccuacugccggaacccgaacaacgagaagggcagccacggggucaagggcugggccuucgacgacgggaacgacguguggaugggccgcaccaucuccgaggagcuccggagcggcuacgagaccuucaaggugaucgggggcugguccacccccaacagcaagcugcagaucaaccgccaggucaucguggacuccgggaaccggagcggcuacagcgggaucuucuccguggagggcaagagcugcaucaaccgcugcuucuacgucgagcugauccggggccgcaagcaggagaccaaggugugguggacguccaacagcaucguggucuucugcgggaccuccggcaccuacgggaccggcagcuggcccgacggggccgacaucaaccucaugcccaucuga

SEQ ID NO: 83078 - RNA, 1410 nt, Artificial Sequence; identical to SEQ ID NO: 76193
  derived and/or modified sequence opt1 from neuraminidase__InfluenzaA__AFH00013

SEQ ID NO: 83079 - RNA, 1410 nt, Artificial Sequence
  derived and/or modified sequence opt1 from neuraminidase__InfluenzaA__AFH00024
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggagaucugccccaagcugguggaguaccggaacugguccaagccgcagugcaagaucaccggguucgcccccuucagcaaggacaacuccauccgccucagcgcgggcggggacaucugggugacccgggagcccuacgucuccugcgaccccggcaagugcuaccaguucgcccuggggcagggcacgacccugaacaaccgccacagcaacgacaccgugcacgaccggaccccguaccgcacgcuccugaugaacgagcugggcgugcccuuccaccucgggaccaagcaggucugcaucgccugguccagcuccagcugccacgacggcaaggccuggcugcacgugugcgugaccgggcacgacgagaacgccaccgcguccuucaucuacgacggccggcuggucgacagcaucggguccuggagcaagaacauccuccgcacgcaggaguccgagugcgugugcaucaacgggaccugcaccguggucaugaccgacggcagcgccuccgagcgggccgacacgaagauccuguucaucgaggagggccgcaucgugcacaucagcccccugagcggcuccgcccagcacguggaggagugcagcugcuacccccgguacccggggguccgcugcgugugccgggacaacuggaagggcuccaaccgccccaucguggacaucaacgucaaggacuacagcaucguguccagcuacgugugcuccggccucgucggggacacgccccggaagaacgacagcuccagcuccagcuacugccgcaaccccaacaacgagaagggcucccacggggugaagggcugggcguucgacgacgggaacgacgucuggaugggccggaccaucagcgaggagcugcgcuccggcuacgagaccuucaaggugaucgggggcuggagcaccccgaacuccaagcugcagaucaaccgccaggugaucgucgaccgggggaaccggagcggcuacuccgggaucuucagcguggagggcaagagcugcaucaaccgcugcuucuacguggagcucauccgcggccggaagcaggagaacaaggucugguggaccuccaacagcaucgugguguucugcgggaccuccggcaccuacgggacgggcagcuggcccgacggggccgacaucaaccugaugcccaucuga

SEQ ID NO: 83080 - RNA, 1410 nt, Artificial Sequence; identical to SEQ ID NO: 76193
  derived and/or modified sequence opt1 from neuraminidase__InfluenzaA__AFH00035

SEQ ID NO: 83081 - RNA, 1410 nt, Artificial Sequence; identical to SEQ ID NO: 76193
  derived and/or modified sequence opt1 from neuraminidase__InfluenzaA__AFH00046

SEQ ID NO: 83082 - RNA, 1410 nt, Artificial Sequence
  derived and/or modified sequence opt1 from neuraminidase__InfluenzaA__AFH00057
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacguccuccgcacccaggaguccgagugcgugugcaucaacggcacgugcaccguggucaugaccgacggcagcgccuccgagcgggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaacccgaacuccaagcugcagaucaaccgccaggugaucgucgaccgggggaaccgcagcggcuacuccgggaucuucagcguggagggcaagagcugcaucaaccggugcuucuacguggagcucauccgcggccgcaagcaggagaccgaggucugguggacguccaacagcaucgugguguucugcgggaccuccggcaccuacgggaccggcagcuggcccgacggggccgacaucaaccugaugcccaucuga

SEQ ID NO: 83083 - RNA, 1410 nt, Artificial Sequence; identical to SEQ ID NO: 76193
  derived and/or modified sequence opt1 from neuraminidase__InfluenzaA__AFH00068

SEQ ID NO: 83084 - RNA, 1410 nt, Artificial Sequence
  derived and/or modified sequence opt1 from neuraminidase__InfluenzaA__AFH00079
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgagggguggagcaagccgaacuccaagcugcagaucaaccgccaggugaucguggaccggggcaaccgcagcggguacuccggcaucuucagcgucgagggcaagagcugcaucaaccggugcuucuacguggagcucauccgcgggcgcaagcaggagaccgaggugugguggacguccaacagcaucgucguguucugcggcaccuccgggaccuacggcaccgggagcuggcccgacggcgccgacaucaaccugaugcccaucuga

SEQ ID NO: 83085 - RNA, 1410 nt, Artificial Sequence
  derived and/or modified sequence opt1 from neuraminidase__InfluenzaA__AFH00090
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcucccacggggucaagggcugggccuucgacgacgggaacgacguguggaugggccggaccaucagcgaggagcugcgcuccggcuacgagaccuucaaggucaucgggggcuggagcaagccgaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83086 - RNA, 1410 nt, Artificial Sequence
  derived and/or modified sequence opt1 from neuraminidase__InfluenzaA__AFH00101
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaagauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83087 - RNA, 1410 nt, Artificial Sequence; identical to SEQ ID NO: 76109
  derived and/or modified sequence opt1 from neuraminidase__InfluenzaA__AFH00112

SEQ ID NO: 83088 - RNA, 1410 nt, Artificial Sequence; identical to SEQ ID NO: 76109
  derived and/or modified sequence opt1 from neuraminidase__InfluenzaA__AFH00123

SEQ ID NO: 83089 - RNA, 1410 nt, Artificial Sequence
  derived and/or modified sequence opt1 from neuraminidase__InfluenzaA__AFH00156
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucaucgacaucaacgugaaggacuacagcaucguguccagcuacgucugcuccggccucgugggggacacgccccgcaagaacgacagcuccagcuccagcuacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggagcaagccgaacuccaagcugcagaucaaccgccaggucaucguggaccgggggaaccgcagcggcuacuccgggaucuucagcguggagggcaagagcugcaucaaccggugcuucuacgucgagcucauccgcggccgcaagcaggagaccgaggugugguggacguccaacagcaucguggucuucugcgggaccuccggcaccuacgggaccggcagcuggcccgacggggccgacaucaaccugaugcccaucuga

SEQ ID NO: 83090 - RNA, 1410 nt, Artificial Sequence
  derived and/or modified sequence opt1 from neuraminidase__InfluenzaA__AFH00167
augaaccccaaccagaagaucaucaccaucggcagcgugucccugaccaucgccacgaugugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83091 - RNA, 1410 nt, Artificial Sequence; identical to SEQ ID NO: 83089
  derived and/or modified sequence opt1 from neuraminidase__InfluenzaA__AFH00178

SEQ ID NO: 83092 - RNA, 1410 nt, Artificial Sequence
  derived and/or modified sequence opt1 from neuraminidase__InfluenzaA__AFH00189
augaaccccaaccagaagaucaucaccaucggcagcgugucccugaccaucgccacgaucugcuuccucaugcagaucgccauccuggucaccaccgugacccugcacuucaagcaguacgaguacaacagcccgcccaacaaccaggugaugcucugcgagcccaagaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccagcuccagcugccacgacggcaaggcguggcugcacgugugcgugacggggcacgacgagaacgccaccgccuccuucaucuacgacggccggcugguggacagcaucggguccuggagcaagaacauccuccgcacccaggaguccgagugcgucugcaucaacgggaccugcacgguggugaugaccgacggcagcgccuccgagcgggcggacaccaagauccuguucaucgaggagggcaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggaccuccaacagcaucgucguguucugcgggacguccggcaccuacgggaccggcagcuggcccgacggggccgacaucaaccugaugcccaucuga

SEQ ID NO: 83093 - RNA, 1410 nt, Artificial Sequence; identical to SEQ ID NO: 76193
  derived and/or modified sequence opt1 from neuraminidase__InfluenzaA__AFH00200

SEQ ID NO: 83094 - RNA, 1410 nt, Artificial Sequence; identical to SEQ ID NO: 83090
  derived and/or modified sequence opt1 from neuraminidase__InfluenzaA__AFH00211

SEQ ID NO: 83095 - RNA, 1410 nt, Artificial Sequence
  derived and/or modified sequence opt1 from neuraminidase__InfluenzaA__AFH00222
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacaacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83096 - RNA, 1410 nt, Artificial Sequence; identical to SEQ ID NO: 76109
  derived and/or modified sequence opt1 from neuraminidase__InfluenzaA__AFH00233

SEQ ID NO: 83097 - RNA, 1410 nt, Artificial Sequence
  derived and/or modified sequence opt1 from neuraminidase__InfluenzaA__AFH00244
augaaccccaaccagaagaucaucaccaucggcagcgugucccugaccaucgccacgaucugcuuccucaugcagaucgccauccuggucaccaccgugacccuguacuucaagcaguacgagugcaacagcccgcccuccaaccaggugaugcucugcgagcccacgaucgucgagcgcaacaucaccgagaucguguaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgucagcugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcuggucgacuccaucgggagcugguccaagaacauccuccgcacccaggagagcgagugcgugugcaucaacggcacgugcaccguggucaugaccgacggcuccgccagcgagcgggcggacaccaagauccuguucaucgaggaggggaagaucgugcacaucagcccccuguccggcagcgccaagcacguggaggagugcuccugcuacccccgcuacccggggguccggugcgugugccgcgacaacuggaagggcagcaaccggcccaucguggacaucaacgucaaggacuacuccaucgugagcuccuacgugugcagcggccucgucggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaagccgaacagcaagcugcagaucaaccgccaggugaucgucgaccgggggaaccgcuccggcuacagcgggaucuucagcguggagggcaaguccugcaucaaccggugcuucuacguggagcucauccgcggccgcaagcaggagaccgaggucugguggacgagcaacuccaucgugguguucugcgggaccagcggcaccuacgggaccggcuccuggcccgacggggccgacaucaaccugaugcccaucuga

SEQ ID NO: 83098 - RNA, 1410 nt, Artificial Sequence; identical to SEQ ID NO: 76193
  derived and/or modified sequence opt1 from neuraminidase__InfluenzaA__AFH00255

SEQ ID NO: 83099 - RNA, 1410 nt, Artificial Sequence; identical to SEQ ID NO: 76193
  derived and/or modified sequence opt1 from neuraminidase__InfluenzaA__AFH00266

SEQ ID NO: 83100 - RNA, 1410 nt, Artificial Sequence
  derived and/or modified sequence opt1 from neuraminidase__InfluenzaA__AFH00277
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacagcauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccagcuccugccacgacggcaaggcguggcugcacgugugcgugaccgggcacgacgagaacgccaccgccagcuucaucuacgacggccggcugguggacuccaucgggagcugguccaagaacauccuccgcacccaggagagcgagugcgucugcaucaacggcacgugcaccguggugaugaccgacggcuccgccagcgagcgggcggacaccaagauccuguucaucgaggaggggaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccucgugggggacacgccccgcaagaacgacuccagcuccagcuccuacugccggaagcccaacaacgagaagggcagccacgggcugaagggcugggccuucgacgacgggaacgacgucuggaugggccgcaccaucuccgaggagcugcggagcggcuacgagaccuucaaggugaucgggggcugguccaagccgaacagcaagcuccagaucaaccgccaggucaucguggaccgggggaaccgcuccggcuacagcgggaucuucagcguggagggcaaguccugcaucaaccggugcuucuacgucgagcugauccgcggccgcaagcaggagaccgaggugugguggacgagcaacuccaucguggucuucugcgggaccagcggcaccuacgggaccggcuccuggcccgacggggccgacaucaaccugaugcccaucuga

SEQ ID NO: 83101 - RNA, 1410 nt, Artificial Sequence; identical to SEQ ID NO: 76193
  derived and/or modified sequence opt1 from neuraminidase__InfluenzaA__AFH00288

SEQ ID NO: 83102 - RNA, 1410 nt, Artificial Sequence; identical to SEQ ID NO: 83025
  derived and/or modified sequence opt1 from neuraminidase__InfluenzaA__AFH00299

SEQ ID NO: 83103 - RNA, 1410 nt, Artificial Sequence
  derived and/or modified sequence opt1 from neuraminidase__InfluenzaA__AFH00310
augaaccccaaccagaagaucaucaccaucggcagcgugucccugaccaucgccacgaucugcuuccucaugcagaucgccauccuggucaccaccgugacccugcacuucaagcaguacgagugcagcuccagcccgaacaaccaggugauccccugccagcccacgaucaucgagcgcaacaucaccgagaucgucuaccucaccaacaccacgaucgagaaggagaucugccccaagcugguggaguaccggaacugguccaagccgcagugcaagaucaccggguucgcgcccuucagcaaggacaacuccauccgccugagcgccggcggggacaucugggugacccgggagcccuacgucuccugcgaccccggcaagugcuaccaguucgcccucgggcagggcaccacgcugaacaaccgccacagcaacgacaccgugcacgaccggaccccguaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucggguccuggagcaagaacauccugcgcacccaggaguccgagugcgugugcaucaacggcacgugcaccguggucaugaccgacggcagcgccagcgagaaggccgacaccaagauccucuucaucgaggaggggaagguggugcacaucagcccccuguccggcuccgcgcagcacgucgaggagugcagcugcuacccccgguacccgggggugcgcugcgugugccgggacaacuggaagggcuccaaccgccccaucgucgacaucaacgugaagaacuacagcaucguguccagcuacgucugcuccggccuggugggggacacgccccggaagaacgacagcuccagcuccagcuacugccgcaaccccaacaacgagaagggcucccacggggucaagggcugggccuucgacgacgggaacgacguguggaugggccggaccaucagcgaggagcuccgcuccggcuacgagaccuucaaggugaucgggggcuggagcaccccgaacuccaagcugcagaucaaccggcaggucaucguggacagcgggaaccgcagcggcuacuccgggaucuucagcguggagggcaaguccugcaucaaccggugcuucuacgucgagcugauccgcggccggaagcaggagacgaaggugugguggaccagcaacucccucguggucuucugcgggaccagcggcaccuacgggacgggcuccuggcccgacggggccgacaucaaccugaugcccaucuga

SEQ ID NO: 83104 - RNA, 1410 nt, Artificial Sequence; identical to SEQ ID NO: 83103
  derived and/or modified sequence opt1 from neuraminidase__InfluenzaA__AFH00321

SEQ ID NO: 83105 - RNA, 1410 nt, Artificial Sequence
  derived and/or modified sequence opt1 from neuraminidase__InfluenzaA__AFH00332
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggguacagcggcaucuucuccgucgagggcaaggggugcaucaaccgcugcuucuacguggagcugauccggggccgcaagcaggagaccgaggugugguggacgagcaacagcaucgucguguucugcgggaccuccggcaccuacgggaccggcagcuggcccgacggcgccgacaucaaccugaugcccaucuga

SEQ ID NO: 83106 - RNA, 1410 nt, Artificial Sequence
  derived and/or modified sequence opt1 from neuraminidase__InfluenzaA__AFH00343
augaaccccaaccagaagaucaucaccaucggcagcgugucccugaccaucgccacgaucugcuuccucaugcagaucgccauccuggucaccaccgugacccugcacuucaagcaguacgagugcaacagcccgcccuccaaccaggcgaugcucugcgagcccacgaucaucgagcgcaacaucaccgagaucguguaccugaccaacaccacgaucgagaaggagaucugccccaagcuggccgaguaccggaacuggagcaagccgcagugcaagaucaccggguucgcccccuucuccaaggacaacagcauccgccucuccgccggcggggacaucugggucacccgggagcccuacgugagcugcgaccccggcaagugcuaccaguucgcccuggggcagggcaccacgcugaacaaccgccacuccaacgacaccgugcacgaccggaccccguaccgcacccuccugaugaacgagcugggcguccccuuccaccucgggacgaagcaggucugcaucgcguggagcuccagcuccugccacgacggcaaggccuggcugcacgugugcgugaccgggcacgacgagaacgccaccgccagcuucaucuacgacggccggcugguggacuccaucgggagcugguccaagaacauccuccgcacccaggagagcgagugcgugugcaucaacggcacgugcaccgucgugaugaccgacggcuccgcgagcgagcgggccgacaccaagauccuguucaucgaggaggggaagaucgugcacaucagcccccuguccggcagcgcccagcacgucgaggagugcuccugcuacccccgcuacccgggggugcggugcgugugccgcgacaacuggaagggcagcaaccggcccaucgucgacaucaacgugaaggacuacuccaucgugagcuccuacgucugcagcggccucgugggggacacgccccgcaagaacgacuccagcuccagcuccuacugccggaaccccaacaacgagaagggcagccacggggugaagggcugggccuucgacgacgggaacgacgucuggaugggccgcaccaucuccgaggagcugcggagcggcuacgagaccuucaaggugaucgggggcugguccaagccgaacagcaagcugcagaucaaccgccaggucaucguggaccgggggaaccgcuccggcuacagcgggaucuucagcguggagggcaaguccugcaucaaccggugcuucuacgucgagcucauccgcggccgcaagcaggagaccgaggugugguggacgagcaacuccaucguggucuucugcgggaccagcggcaccuacgggaccggcuccuggcccgacggggccgacaucaaccugaugcccaucuga

SEQ ID NO: 83107 - RNA, 1410 nt, Artificial Sequence
  derived and/or modified sequence opt1 from neuraminidase__InfluenzaA__AFH00354
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccaagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggguacagcggcaucuucuccgucgagggcaagagcugcgugaaccgcugcuucuacguggagcugauccgggggcgcaagcaggagaccgaggucugguggacgagcaacuccaucgugguguucugcggcaccagcgggaccuacggcaccggguccuggcccgacggcgccgacaucaaccugaugcccaucuga

SEQ ID NO: 83108 - RNA, 1410 nt, Artificial Sequence; identical to SEQ ID NO: 75988
  derived and/or modified sequence opt1 from neuraminidase__InfluenzaA__AFH00365

SEQ ID NO: 83109 - RNA, 1410 nt, Artificial Sequence
  derived and/or modified sequence opt1 from neuraminidase__InfluenzaA__AFH00376
augaaccccaaccagaagaucaucaccaucggcagcgugucccugaccaucgccacgaucugcuuccucaugcagaucgccauccuggucaccaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 83110 - RNA, 1410 nt, Artificial Sequence
  derived and/or modified sequence opt1 from neuraminidase__InfluenzaA__AFH00387
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucuccagcugguccaagaacauccuccgcacccaggagagcgagugcgucugcaucaacggcacgugcaccguggugaugaccgacggguccgccagcgagcgggcggacaccaagauccuguucaucgaggagggcaagaucguccacaucagcccccuguccggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcgggcucgugggcgacacgccccgcaagaacgacuccagcuccagcuccuacugccugaaccccaacaacgaggagggcgggcacggcgucaaggggugggccuucgacgacggcaacgacguguggauggggcggaccaucagcgagaagcugcgcuccggcuacgagaccuucaaggucaucggcggguggagcaagccgaacuccaagcuccagaucaaccgccaggugaucguggaccggggcaaccggagcggguacuccggcaucuucagcgucgagggcaagagcugcgugaaccgcugcuucuacguggagcugauccgggggcgcaagcaggagaccgaggucugguggacguccaacagcaucgugguguucugcggcaccuccgggaccuacggcaccgggagcuggcccgacggcgccgacaucaaccugaugcccaucuga

SEQ ID NO: 83111 - RNA, 1410 nt, Artificial Sequence
  derived and/or modified sequence opt1 from neuraminidase__InfluenzaA__AFH00398
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccugaaccccaacaacgaggagggcgggcacggcgucaaggggugggccuucgacgacggcaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggguacagcggcaucuucuccgucgagggcaagagcugcgugaaccgcugcuucuacguggagcugauccgggggcgcaagcaggagaccgaggucugguggacgagcaacuccaucgugguguucugcggcaccagcgggaccuacggcgccggguccuggcccgacggcgccgacaucaaccugaugcccaucuga

SEQ ID NO: 83112 - RNA, 1410 nt, Artificial Sequence
  derived and/or modified sequence opt1 from neuraminidase__InfluenzaA__AFH00409
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacaacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagcuacugccugaaccccaacaacgaggagggcgggcacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggacgagcaacuccaucgucguguucugcgggaccagcggcaccuacgggaccggcuccuggcccgacggcgccgacaucaaccugaugcccaucuga

SEQ ID NO: 83113 - RNA, 1410 nt, Artificial Sequence; identical to SEQ ID NO: 75988
  derived and/or modified sequence opt1 from neuraminidase__InfluenzaA__AFH00420

SEQ ID NO: 83114 - RNA, 1410 nt, Artificial Sequence; identical to SEQ ID NO: 76121
  derived and/or modified sequence opt1 from neuraminidase__InfluenzaA__AFH00431

SEQ ID NO: 83115 - RNA, 1410 nt, Artificial Sequence
  derived and/or modified sequence opt1 from neuraminidase__InfluenzaA__AFH00442
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccagcuccagcugccacgacggcaaggcguggcugcacgugugcgugacggggcacaacgagaacgccaccgccuccuucaucuacgacggccggcugguggacagcaucggguccuggagcaagaacauccuccgcacccaggaguccgagugcgucugcaucaacgggaccugcacgguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcggccacggggucaagggcugggccuucgacgacggcaacgacguguggauggggcggaccaucuccgagaagcugcgcagcggcuacgagaccuucaaggucaucgggggcugguccaagccgaacagcaagcuccagaucaaccgccaggugaucguggaccgggggaaccgguccggcuacagcggcaucuucuccgucgagggcaagagcugcaucaaccgcugcuucuacguggagcugauccgggggcgcaagcaggagaccgaggugugguggaccagcaacuccaucgucguguucugcgggacgagcggcaccuacgggaccggcuccuggcccgacggcgccgacaucaaccugaugcccaucuga

SEQ ID NO: 83116 - RNA, 1410 nt, Artificial Sequence
  derived and/or modified sequence opt1 from neuraminidase__InfluenzaA__AFH00453
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgaggucguguaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacgucuccugcgaccccgacaagugcuaccaguucgcccugggccaggggaccacgcugaacaaccgccacagcaacgacaucgugcacgaccggaccccguaccgcacccuccugaugaacgagcugggcgugcccuuccaccucggcaccaagcaggucugcaucgccugguccagcuccagcugccacgacgggaaggcguggcugcacgugugcgugacgggccacgacgagaacgccaccgccuccuucaucuacgacgggcggcuggucgacagcaucggcuccuggagcaagaagauccuccgcacccaggaguccgagugcgugugcaucaacgggaccugcacgguggucaugaccgacggcagcgccuccggccgggcggacaccaagauccuguucaucgaggaggggaagaucgugcacaucagcccccugagcggcuccgcccagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagccacugccugaaccccaacaacgaggagggcgggcacggcgugaaggggugggccuucgacgacggcaacgacgucuggaugggccggaccaucuccgagaagcugcgcagcggguacgagaccuucaaggugaucggcgggugguccaagccgaacagcaagcuccagaucaaccgccaggugaucgucgaccggggcaaccgguccggguacagcggcaucuucuccguggagggcaagagcugcaucaaccgcugcuucuacguggagcugauccgggggcgcaagcaggagaccgaggucugguggaccagcaacuccaucgugguguucugcggcacgagcgggaccuacggcaccggguccuggcccgacggcgccgacaucaaccugaugcccaucuga

SEQ ID NO: 83117 - RNA, 1410 nt, Artificial Sequence
  derived and/or modified sequence opt1 from neuraminidase__InfluenzaA__AFH00464
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaagaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacggcgggcggcugguggacagcaucggcuccuggagcaagaagauccuccgcacccaggaguccgagugcgucugcaucaacggcacgugcaccguggugaugaccgacgggagcgccuccggccgggcggacaccaagauccuguucaucgaggaggggaagaucguccacaucagcccccugagcggcuccgcccagcacguggaggagugcagcugcuacccccgcuacccgggcgugcggugcgucugccgcgacaacuggaagggguccaaccggcccaucguggacaucaacgugaaggacuacagcaucgucuccagcuacgugugcuccggccucgugggggacacgccccgcaagaacgacagcuccagcuccagcuacugccugaaccccaacaacgaggagggcgggcacggcgucaagggcugggccuucgacgacgggaacgacguguggaugggccggaccaucuccgagaagcugcgcagcggguacgagaccuucaaggucaucggcgggugguccaagccgaacagcaagcuccagaucaaccgccaggugaucguggaccggggcaaccgguccggcuacagcgggaucuucuccgucgagggcaagagcugcaucaaccgcugcuucuacguggagcugauccgggggcgcaagcaggagaccgaggugugguggacgagcaacuccaucgucguguucugcggcaccagcgggaccuacggcaccggcuccuggcccgacggggccgacaucaaccugaugcccaucuga

SEQ ID NO: 83118 - RNA, 1410 nt, Artificial Sequence
  derived and/or modified sequence opt1 from neuraminidase__InfluenzaA__AFH00475
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcaaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagccgaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagaccgaggugugguggacgagcaacuccaucgucguguucugcgggaccagcggcaccuacgggaccggcuccuggcccgacggggccgacaucaaccugaugcccaucuga

SEQ ID NO: 83119 - RNA, 1410 nt, Artificial Sequence
  derived and/or modified sequence opt1 from neuraminidase__InfluenzaA__AFH00486
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugcucggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcuccgcuccggguacgagaccuucaaggucaucgagggcuggagcaagccgaacuccaagcugcagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggggccgacaucaaccucaugcccaucuga

SEQ ID NO: 83120 - RNA, 1410 nt, Artificial Sequence
  derived and/or modified sequence opt1 from neuraminidase__InfluenzaA__AFH00497
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucaagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagcugcgcagcggguacgagaccuucaaggucaucggcgggugguccaagccgaacagcaagcugcagaucaaccgccaggugaucguggaccggggcaaccgguccggguacagcggcaucuucuccgucgagggcaagagcugcaucaaccgcugcuucuacguggagcucauccgggggcgcaagcaggagaccgaggugugguggacgagcaacuccaucgucguguucugcggcaccagcgggaccuacggcaccggguccuggcccgacggcgccgacaucaaccugaugcccaucuga

SEQ ID NO: 83121 - RNA, 1410 nt, Artificial Sequence
  derived and/or modified sequence opt1 from neuraminidase__InfluenzaA__AFH00508
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccagcuccagcugccacgacggcaaggcguggcugcacgugugcgugacggggcacaacgagaacgccaccgccuccuucaucuacgacggccggcugguggacagcaucggguccuggagcaagaacauccuccgcacccaggaguccgagugcgucugcaucaacgggaccugcacgguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccugaaccccaacaacgaggagggcggccacggggucaagggcugggccuucgacgacggcaacgacguguggauggggcggaccaucuccgagaagcugcgcagcggcuacgagaccuuccgggucaucgggggcugguccaagccgaacagcaagcuccagaucaaccgccaggugaucguggaccgggggaaccgcuccggcuacagcggcaucuucuccgucgagggcaagagcugcaucaaccggugcuucuacguggagcugauccgcgggcgcaagcaggagaccgaggugugguggaccagcaacuccaucgucguguucugcgggacgagcggcaccuacgggaccggcuccuggcccgacggcgccgacaucaaccugaugcccaucuga

SEQ ID NO: 83122 - RNA, 1410 nt, Artificial Sequence
  derived and/or modified sequence opt1 from neuraminidase__InfluenzaA__AFH00519
augaaccccaaccagaagaucaucaccaucggcagcgugucccugaccaucgccacgaugugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaacggccacagcaacgacaccguccacgaccgcaccccguaccggacccuccugaugaacgagcugggggugcccuuccaccucggcacgaagcaggucugcaucgccugguccagcuccagcugccacgacgggaaggcguggcugcacgugugcgugaccggccacgacgagaacgccaccgccuccuucaucuacgacgggcgccugguggacagcaucggcuccuggagcaagaacauccuccggacccaggaguccgagugcgucugcaucaacggcacgugcaccguggugaugaccgacgggagcgccuccggccgcgcggacaccaagauccuguucaucgaggaggggaagaucguccacaucagcccccugagcggcuccgcccagcacguggaggagugcagcugcuacccccgguacccgggcgugcgcugcgucugccgggacaacuggaagggguccaaccgccccaucguggacaucaacgugaaggacuacagcaucgucuccagcuacgugugcuccggccucgugggggacacgccccggaagaacgacagcuccagcuccagccacugccugaaccccaacaacgaggagggcgggcacggcgucaagggcugggccuucgacgacgggaacgacguguggaugggccgcaccaucuccgagaagcugcggagcggguacgagaccuucaaggucaucggcgggugguccaagccgaacagcaagcuccagaucaaccgccaggugaucguggaccggggcaaccgcuccggcuacagcgggaucuucuccgucgagggcaagagcugcaucaaccggugcuucuacguggagcugauccgcgggcggaagcaggagaccgaggugugguggacgagcaacuccaucgucguguucugcggcaccagcgggaccuacggcaccggcuccuggcccgacggggccgacaucaaccugaugcccaucuga

SEQ ID NO: 83123 - RNA, 1410 nt, Artificial Sequence; identical to SEQ ID NO: 75581
  derived and/or modified sequence opt1 from neuraminidase__InfluenzaA__AFH00530

SEQ ID NO: 83124 - RNA, 1410 nt, Artificial Sequence; identical to SEQ ID NO: 75581
  derived and/or modified sequence opt1 from neuraminidase__InfluenzaA__AFH00541

SEQ ID NO: 83125 - RNA, 1410 nt, Artificial Sequence
  derived and/or modified sequence opt1 from neuraminidase__InfluenzaA__AFH00552
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgacgggcggcucguggacagcaucggcuccuggagcaagaagauccugcgcacccaggaguccgagugcgucugcaucaacgggacgugcaccguggugaugaccgacggcagcgccuccggccgggcggacaccaagauccuguucaucgaggaggggaagaucauccacaucagccagcucagcggcuccacgcagcacgucgaggagugcagcugcuacccccgcuaccccggggugcggugcgugugccgcgacaacuggaagggcuccaaccggcccaucgucgacaucaacgugaaggacuacagcaucguguccagcuacgucugcuccggccuggugggggacaccccgcgcaagaacgacagcuccagcuccagccacugccugaaccccaacaacgaggagggcgggcacggcgugaaggggugggccuucgacgacggcaacgacgucuggaugggccggaccaucuccgagaaguuccgcagcggguacgagaccuucaaggugaucgagggcugguccaagcccaacagcaagcuccagaucaaccggcaggucaucguggaccgcgacaaccgguccggguacagcggcaucuucuccguggagggcaagagcugcaucaaccgcugcuucuacgucgagcugauccgggggcgcaagcaggagacggaggugugguggaccagcaacuccaucguggucuucugcggcaccagcgggaccuacggcacgggguccuggcccgacggcgccgacaucaaccugaugccgaucuga

SEQ ID NO: 83126 - RNA, 1410 nt, Artificial Sequence
  derived and/or modified sequence opt1 from neuraminidase__InfluenzaA__AFH00563
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugugcuccgggcucgugggcgacacgccccgcaagaacgacagcuccagcuccagccacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacagcaagcuccagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcuguggaccagcaacuccaucgucguguucugcggcaccagcgggaccuacggcacgggguccuggcccgacggcgccgacaucaaccucaugcccaucuga

SEQ ID NO: 83127 - RNA, 1410 nt, Artificial Sequence
  derived and/or modified sequence opt1 from neuraminidase__InfluenzaA__AFH00574
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccaagaucaucgagcgcaacaucacggagaucgucuaccugaacaacaccaccaucgagaaggagaucugccccaagcuggcggaguaccggaacugguccaagccgcagugcaacaucaccggguucgcccccuucagcaaggacaacuccauccgccucagcgccggcggggacaucugggugacgcgggagcccuacguguccugcgaccccgacaagugcuaccaguucgcccugggccaggggaccacccugaacaacggccacagcaacgacaccguccacgaccgcacgccguaccggacccuccugaugaacgagcugggcgugcccuuccaccucgggaccaagcaggucugcaucgccugguccagcuccagcugccacgacggcaaggcguggcugcacgugugcgugaccggggacgacgagaacgccacggccuccuucaucuacaacggccgccugguggacagcaucggguccuggagcaagaagauccuccggacccaggaguccgagugcgucugcaucaacgggaccugcaccguggugaugacggacggcagcgccuccgggaaggcggacaccaagauccuguucaucgaggagggcaagaucguccacaccagccugcucagcggguccgcccagcacguggaggagugcagcugcuacccccgcuaccccggcgugcggugcgucugccgcgacaacuggaagggcuccaaccggccgaucguggacaucaacgugaaggacuacagcaucgucuccagcuacgugugcuccgggcuggugggcgacacgccccgcaagaacgacagcuccagcuccagccacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacagcaagcugcagaucaaccgccaggugaucguggaccggggcaaccgguccggguacagcggcaucuucuccgucgagggcaagagcugcaucaaccgcugcuucuacguggagcugauccgggggcgcaagcaggagaccgaggugcucuggaccagcaacuccaucgucguguucugcggcacgagcgggaccuacggcaccggguccuggccggacggcgccgacaucaaccugaugcccaucuga

SEQ ID NO: 83128 - RNA, 1410 nt, Artificial Sequence
  derived and/or modified sequence opt1 from neuraminidase__InfluenzaA__AFH00585
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucaagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaagguccacgaccggaccccguaccgcacccuccugaugaacgagcugggcgugcccuuccaccucggcaccaagcaggucugcaucgccugguccagcuccagcugccacgacgggaaggcguggcugcacgugugcgugacgggcgacgacgagaacgccaccgccuccuucaucuacaacgggcggcugguggacagcaucggcuccuggagcaagaagauccuccgcacccaggaguccgagugcgucugcaucaacgggaccugcacgguggugaugaccgacggcagcgccuccggcaaggcggacaccaagauccuguucaucaaggaggggaagaucguccacaccagcagccuguccggcagcgcccagcacguggaggagugcuccugcuacccccgguaccccggggugcgcugcgucugccgggacaacuggaagggcagcaaccgcccgaucguggacaucaacgugaaggacuacuccaucgucagcuccuacgugugcagcggccucgugggggacacgccccggaagaacgacuccagcuccagcucccacugccuggaccccaacaacgaggagggcgggcacggcgucaaggggugggccuucgacgacggcaacgacguguggaugggccgcaccaucagcgagaagcugcgguccggguacgagaccuucaaggucaucgagggcuggagcaaggccaacuccaagcuccagaucaaccgccaggugaucguggaccgggggaaccgcagcggcuacuccgggaucuucagcgucgagagcaaguccugcaucaaccggugcuucuacguggagcugauccgcggccggaagcaggagaccgaggugcuguggacgagcaacuccaucgucguguucugcggcaccagcgggaccuacggcaccggguccuggcccgacggcgccgacaucaaccucaugccgaucuga

SEQ ID NO: 83129 - RNA, 1410 nt, Artificial Sequence; identical to SEQ ID NO: 75716
  derived and/or modified sequence opt1 from neuraminidase__InfluenzaA__AFH00596

SEQ ID NO: 83130 - RNA, 1410 nt, Artificial Sequence
  derived and/or modified sequence opt1 from neuraminidase__InfluenzaA__AFH00607
augaaccccaaccagaagaucaucaccaucggcuucguguucuucaccaucgccacgaucugcuuccugaugcagaucgccauccucgucaccaccgugacccugcacuucaagcaguacgagugcaacccgccgcccaacaaccaggugaugcugugcgagcccacgaucaucgagcgcaacaucaccgagaucgucuaccucaccaacaccacgaucgagaaggagaucugccccaagcuggcggaguaccggaacuggagcaagccccagugcaacaucaccggguucgcccccuucuccaaggacaacagcauccgccuguccgccggcggggacaucugggugacccgggagcccuacgugagcugcgacccggacaagugcuaccaguucgcccucggccaggggaccacgcugaacaacggccacuccaacgacaccguccacgaccgcacccccuaccggacccugcucaugaacgagcugggcgugcccuuccaccuggggacgcgccaggugugcaucgccuggagcuccagcuccugccacgacggcaaggcguggcuccacgucugcgugaccggggacgacgagaacgccaccgccagcuucaucuacaacggccggcugguggacuccaucgggagcugguccaagaagauccugcgcacccaggagagcgagugcgucugcaucaacggcacgugcaccguggugaugaccgacggcuccgccagcgggaaggcggacaccaagauccucuucaucgaggagggcaagaucguccacaucuccacgcugagcggguccgcccagcacguggaggagugcagcugcuacccccgguacccgggcgugcgcugcgucugccgggacaacuggaagggcagcaaccgccccaucguggacaucaacgugaaggacuacuccaucgucagcuccuacgugugcagcgggcuggugggcgacacgccccggaagaacgacuccuucagcuccagccacugccucgaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacagcaagcugcagaccaaccgccaggugaucguggagcggggcaaccgcuccggguacagcggcaucuucuccgucgagggcaagagcugcaucaaccggugcuucuacguggagcucauccgcgggcggaaggaggagaccgaggugugguggaccuccaacagcaucgucguguucugcggcaccuccgggacguacggcaccgggagcuggcccgacggcgccgacaucaaccugaugcccaucuga

SEQ ID NO: 83131 - RNA, 1410 nt, Artificial Sequence; identical to SEQ ID NO: 76937
  derived and/or modified sequence opt1 from neuraminidase__InfluenzaA__AFH00618

SEQ ID NO: 83132 - RNA, 1410 nt, Artificial Sequence
  derived and/or modified sequence opt1 from neuraminidase__InfluenzaA__AFH00629
augaaccccaaccagaagaucaucaccaucggcagcgugucccugaccaucgccacgaucugcuuccucaugcagaucaccauccuggucaccaccgugacgcugcacuucaagcaguacgagugcaacagcccgcccaacaaccaggugaugcucugcgagcccaccaucaucgagcgcaacaucaccgagaucgucuaccugaccaacacgaccaucgagaaggggaucugccccaagcuggccgaguaccggaacugguccaagccgcagugcaacaucaccggcuucgcgcccuucagcaaggacaacuccauccgccucagcgccgggggcgacaucugggugacccgggagcccuacguguccugcgaccccgacaagugcuaccaguucgcccuggggcagggcacgacccugaacaacggccacagcaacgacaccguccacgaccgcaccccguaccggacgcuccugaugaacgagcugggggugcccuuccaccucggcacccgccaggugugcaucgccugguccagcuccagcugccacgacgggaaggccuggcugcacgucugcgugaccggcgacgacaagaacgcgaccgccuccuucaucuacaacgggcggcugguggacagcaucggcuccuggagcaagaagauccuccgcacgcaggaguccgagugcgucugcaucaacgggaccugcaccguggugaugaccgacggcagcgccuccggcaaggccgacacgaagauccuguucaucgaggaggggaagaucauccacaucagcacccugcucggcagcgcgcagcacgucgaggagugcuccugcuacccccgguaccccggcgugcgcugcgugugccgggacaacuggaaggggagcaaccgcccgaucgucgacaucaacgugaaggacuacuccaucgugagcuccuacgucugcagcggccuggugggggacacgccccggaagaacgacuccagcuccagcucccacugccuggaccccaacaacgaggagggcgggcacggcgugaagggcugggccuucgacgacgggaacgacgucuggaugggccgcaccaucagcgagaagcuccgguccggguacgagaccuucaaggugaucgagggcuggagcaagcccaacuccaagcugcagaucaaccgccaggucaucguggagcgggggaaccgcagcggcuacuccggcaucuucagcguggaggggaaguccugcaucaaccggugcuucuacgucgagcugauccgcggccggaaggaggagaccgaggugugguggaccagcaacagcaucguggucuucugcgggaccuccggcacguacgggaccggcagcuggccggacggcgccgacaucaaccucaugcccaucuga

SEQ ID NO: 83133 - RNA, 1410 nt, Artificial Sequence; identical to SEQ ID NO: 75335
  derived and/or modified sequence opt1 from neuraminidase__InfluenzaA__AFH00640

SEQ ID NO: 83134 - RNA, 1410 nt, Artificial Sequence; identical to SEQ ID NO: 77464
  derived and/or modified sequence opt1 from neuraminidase__InfluenzaA__AFH00651

SEQ ID NO: 83135 - RNA, 1410 nt, Artificial Sequence; identical to SEQ ID NO: 75335
  derived and/or modified sequence opt1 from neuraminidase__InfluenzaA__AFH00662

SEQ ID NO: 83136 - RNA, 1410 nt, Artificial Sequence
  derived and/or modified sequence opt1 from neuraminidase__InfluenzaA__AFH00673
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucgagcgcaacaucaccgagaucguguaccucaccaacaccacgaucgagaaggagaccugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggacgacccugaacaacgugcacagcaacgacaccguccacgaccgcaccccguaccggacgcugcucaugaacgagcugggcgugcccuuccaccugggcaccaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacgcaggaguccgagugcgugugcaucaacgggaccugcaccguggucaugaccgacgggagcgccagcggcaaggccgacacgaagauccucuucaucgaggagggcaagaucgugcacaccuccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgucaagucccggagcggcuacgagaccuucaaggugaucgaggggugguccaaccccaacagcaagcugcagaucaaccgccaggugaucgucgaccggggcaaccgcuccggguacagcggcaucuucagcguggaggggaaguccugcaucaaccggugcuucuacguggagcugauccgcggccggaaggaggagaccgagguccucuggaccagcaacuccaucgugguguucugcggcacgagcgggaccuacggcaccggguccuggccggacggcgccgacaucaaccugaugcccaucuga

SEQ ID NO: 83137 - RNA, 1410 nt, Artificial Sequence
  derived and/or modified sequence opt1 from neuraminidase__InfluenzaA__AFH00684
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgagcggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 83138 - RNA, 1410 nt, Artificial Sequence
  derived and/or modified sequence opt1 from neuraminidase__InfluenzaA__AFH00695
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgagcggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 83139 - RNA, 1410 nt, Artificial Sequence
  derived and/or modified sequence opt1 from neuraminidase__InfluenzaA__AFH00706
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacaacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 83140 - RNA, 1410 nt, Artificial Sequence
  derived and/or modified sequence opt1 from neuraminidase__InfluenzaA__AFH00728
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggacccgccaggugugcaucgccuggagcuccagcuccugccacgacggcaaggccuggcuccacgucugcgugacggggcacgacaagaacgcgaccgccagcuucaucuacaacggccggcugguggacuccaucgggagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccggcagcgcgcagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccuggugggggacacgccccgcaagaacgaccgguccagcuccagcuacugccgcaacccgaacaacgagaagggcaaccacggggucaagggcugggccuucgacgacgggaacgacguguggaugggccggaccaucggcgaggagcuccgcuccggguacgagaccuucaaggucaucggcggguggagcacccccaacuccaagcugcagaucaaccgccaggugaucguggacagcgacaaccgguccggcuacagcgggaucuucuccgucgagggcaagagcugcaucaaccggugcuucuacguggagcugauccgcggccgcgagcaggagacccgggugcucuggacgagcaacuccaucgucguguucugcgggaccagcggcaccuacgggaccggcuccuggcccgacggggccgacaucaaccugaugcccaucuga

SEQ ID NO: 83141 - RNA, 1410 nt, Artificial Sequence
  derived and/or modified sequence opt1 from neuraminidase__InfluenzaA__AFH00739
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgacuccggcaaccggagcggguacuccggcaucuucagcguggagggcaagagcugcaucaaccggugcuucuacguggagcugauccgcgggcgcggccaggagacgcgggucugguggaccuccaacagcaucgugguguucugcgggaccuccggcaccuacgggacgggcagcuggcccgacggcgccgacaucaaccucaugcccaucuga

SEQ ID NO: 83142 - RNA, 1410 nt, Artificial Sequence
  derived and/or modified sequence opt1 from neuraminidase__InfluenzaA__AFH00750
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccuacaccaagauccucuucaucaaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagaucaaccgccaggugaucgucgaguccggcaaccggagcggguacuccggcaucuucagcguggagggcaagagcugcaucaaccggugcuucuacguggagcugauccgcgggcgcgagcaggagacgcgggucugguggaccuccaacagcaucgugguguucugcggcaccuccgggaccuacggcacggggagcuggcccgacggcgccgacaucaaccucaugcccaucuga

SEQ ID NO: 83143 - RNA, 1410 nt, Artificial Sequence
  derived and/or modified sequence opt1 from neuraminidase__InfluenzaA__AFH00761
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugagcgccggcggggacaucugggugacccgggagcccuacgucuccugcgacccgggcaagugcuaccaguucgcccucgggcagggcaccacgcugaacaaccgccacagcaacgacaccgugcacgaccggacccccuaccgcacccugcucaugaacgagcugggcgugcccuuccaccuggggacgaagcaggucugcaucgccugguccagcuccagcugccacgacggcaaggccuggcuccacgugugcgugaccgggcacgacgagaacgcgaccgccuccuucaucuacgacggccggcuggucgacagcaucggguccuggagcaagaacauccugcgcacccaggaguccgagugcgugugcaucaacggcacgugcaccguggucaugaccgacggcagcgccuccgagcgggccgacaccaagauccucuucaucgaggaggggaagaucgugcacaucagcccccugagcggcuccgcgcagcacguggaggagugcagcugcuacccgcgcuaccccgggguccggugcgugugccgcgacaacuggaagggcuccaaccggcccaucguggacaucaacgucaaggacuacagcaucguguccagcuacgugugcuccggccuggucggggacacgccccgcaagaacgacagcuccagcuccagcuacugccggaacccgaacaacgagaagggcucccacggggugaagggcugggccuucgacgacggggacgacgucuggaugggccgcaccaucggcgaggagcuccggagcggguacgagaccuucaaggugaucggcgggugguccacccccaacagcaagcugcagaucaaccgccaggugaucgucgaccggggcaaccgcuccggguacagcggcaucuucuccguggagggcaagagcugcaucaaccggugcuucuacguggagcugauccgcgggcgcaagcaggagacgaaggucugguggaccagcaacuccaucgugguguucugcggcaccagcgggaccuacggcacgggguccuggcccgacggcgccgacaucaaccucaugcccaucuga

SEQ ID NO: 83144 - RNA, 1410 nt, Artificial Sequence
  derived and/or modified sequence opt1 from neuraminidase__InfluenzaA__AFH00783
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccgcgggaccacgcugaacaaccggcacagcaacgacaccguccacgaccgcaccccguaccggacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcgccugguggacagcaucggcuccuggagcaagaagauccuccggacccaggaguccgagugcgucugcaucaacgggacgugcaccguggugaugaccgacggcagcgccuccggccgcgcggacaccaagauccuguucaucgaggaggggaagaucguccacaucagcccccugagcggcuccgcccagcacguggaggagugcagcugcuacccccgguacuccggggugcgcugcgucugccgggacaacuggaagggcagcaaccgcccgaucguggacaucaacgugaaggacuacuccaucgucagcuccuacgugugcagcggccucgugggggacacgccccggaagaacgacuccagcuccagcucccacugccugaaccccaacaacgaggagggcgggcacggcgucaaggggugggccuucgacgacggcaacgacguguggaugggccgcaccaucagcgagaaguuccgguccggguacgagaccuucaaggucaucggcggguggagcaagcccaacuccaagcugcagaucaaccgccaggugaucguggaccggggcaaccgcagcggguacuccggcaucuucagcgucgagggcaagagcugcaucaaccggugcuucuacguggagcucauccgcgggcgcaagcaggagaccgaggugugguggacguccaacagcaucgucguguucugcggcaccuccgggaccuacggcaccgggagcuggccggacggcgccgacaucaaccugaugcccaucuga

SEQ ID NO: 83145 - RNA, 1410 nt, Artificial Sequence
  derived and/or modified sequence opt1 from neuraminidase__InfluenzaA__AFH00794
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggagcuccagcuccugccacgacgggaaggccuggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgcgagcgagcgggccgacaccaagauccuguucaucgaggagggcaagaucguccacaucucccagcugagcgggagcgcccagcacguggaggagugcuccugcuacccccgcuaccccggcgugcggugcgucugccgcgacaacuggaaggggagcaaccggccgaucguggacaucaacgugaaggacuacuccaucgucagcuccuacgugugcagcggccucgugggcgacacgccccgcaagaacgacuccagcuccagcucccacugccugaaccccaacaacgaggagggcgggcacggggucaagggcugggccuucgacgacggggacgacguguggaugggccggaccaucagcgagaagcugcgcuccggcuacgagaccuucaaggucaucgagggguggagcaagcccaacuccaagcuccagaccaaccgccaggugaucguggaccggggcaaccggagcggguacuccggcaucuucagcgucgaggggaaguccugcaucaaccgcugcuucuacguggagcugauccggggccgcaagcaggagacggaggugugguggaccagcaacagcaucgucguguucugcggcaccuccgggaccuacggcacggggagcuggccggacggcgccgacaucaaccugaugcccaucuga

SEQ ID NO: 83146 - RNA, 1410 nt, Artificial Sequence; identical to SEQ ID NO: 76496
  derived and/or modified sequence opt1 from neuraminidase__InfluenzaA__AFH00805

SEQ ID NO: 83147 - RNA, 1410 nt, Artificial Sequence; identical to SEQ ID NO: 80526
  derived and/or modified sequence opt1 from neuraminidase__InfluenzaA__AFH00816

SEQ ID NO: 83148 - RNA, 1410 nt, Artificial Sequence
  derived and/or modified sequence opt1 from neuraminidase__InfluenzaA__AFH00827
augaaccccaaccagaagaucaucaccaucggcagcgugucccugaccaucagcacgaccugcuucuucaugcagaucgccauccucaucaccaccgucacgcugcacuucaagcaguacgaguucaacuccccgcccaacaaccaggugaugcugugcgagcccaccaucaucgagcgcaacaugaccgagaucguguaccucaccaacacgaccaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcacgaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggcccgacggcgccgaccugaaccugaugccccucuga

SEQ ID NO: 83149 - RNA, 1410 nt, Artificial Sequence; identical to SEQ ID NO: 76937
  derived and/or modified sequence opt1 from neuraminidase__InfluenzaA__AFH01410

SEQ ID NO: 83150 - RNA, 1410 nt, Artificial Sequence
  derived and/or modified sequence opt1 from neuraminidase__InfluenzaA__AFH34942
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccgcaaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggaagcucguggacuccguggucagcugguccaaggagauccugcggacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcggccacggggucaagggcugggccuucgacgacgggaacgacguguggaugggccggaccaucaacgagaccagccgccucggcuacgagacguucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcaccagcgggacguacggcaccggguccuggcccgacggcgccgaccugaaccugaugcccaucuga

SEQ ID NO: 83151 - RNA, 1410 nt, Artificial Sequence
  derived and/or modified sequence opt1 from neuraminidase__InfluenzaA__AFH34956
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcggccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaacgaggugcucuggaccagcaacuccaucgucguguucugcgggaccagcggcacguacgggaccggcuccuggcccgacggggccgaccugaaccugaugcccaucuga

SEQ ID NO: 83152 - RNA, 1410 nt, Artificial Sequence
  derived and/or modified sequence opt1 from neuraminidase__InfluenzaA__AFH34963
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaucguccgcgaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaacgaggugcucuggaccagcaacuccaucgucguguucugcggcaccagcgggaccuacggcacgggguccuggcccgacggcgccgaccugaaccugaugcccaucuga

SEQ ID NO: 83153 - RNA, 1410 nt, Artificial Sequence
  derived and/or modified sequence opt1 from neuraminidase__InfluenzaA__AFH34970
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaacgaggugcucuggaccagcaacuccaucgucguguucugcggcaccagcgggacguacggcaccggguccuggcccgacggcgccgaccugaaccugaugcccaucuga

SEQ ID NO: 83154 - RNA, 1410 nt, Artificial Sequence
  derived and/or modified sequence opt1 from neuraminidase__InfluenzaA__AFH34977
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 83155 - RNA, 1410 nt, Artificial Sequence
  derived and/or modified sequence opt1 from neuraminidase__InfluenzaA__AFH74468
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggcuccgccagcggcaaggccgacacgaagauccucuucaucgaggagggccggaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggggacaacggcgucaaggggugggccuucgacgacggcaacgacguguggauggggcggaccaucagcgagaagucccgccugggcuacgagaccuucaaggucaucgagggcuggagcaaccccaaguccaagcugcagaucaaccgccaggugaucguggaccgggggaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcacguccggcaccuacgggaccggcagcuggccggacggggccgacaucaaccugaugcccaucuga

SEQ ID NO: 83156 - RNA, 1410 nt, Artificial Sequence; identical to SEQ ID NO: 79659
  derived and/or modified sequence opt1 from neuraminidase__InfluenzaA__AFH74469

SEQ ID NO: 83157 - RNA, 1410 nt, Artificial Sequence; identical to SEQ ID NO: 77607
  derived and/or modified sequence opt1 from neuraminidase__InfluenzaA__AFH74480

SEQ ID NO: 83158 - RNA, 1410 nt, Artificial Sequence; identical to SEQ ID NO: 77607
  derived and/or modified sequence opt1 from neuraminidase__InfluenzaA__AFH74491

SEQ ID NO: 83159 - RNA, 1410 nt, Artificial Sequence; identical to SEQ ID NO: 82650
  derived and/or modified sequence opt1 from neuraminidase__InfluenzaA__AFH74502

SEQ ID NO: 83160 - RNA, 1410 nt, Artificial Sequence
  derived and/or modified sequence opt1 from neuraminidase__InfluenzaA__AFH74513
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccguguga

SEQ ID NO: 83161 - RNA, 1410 nt, Artificial Sequence
  derived and/or modified sequence opt1 from neuraminidase__InfluenzaA__AFH74524
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgaucaacaacgugcacuccaacaacaccguccgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcgucgugguguucugcggcaccuccgggacguacggcaccgggagcuggccggacggcgccgacaucaaccugaugcccaucuga

SEQ ID NO: 83162 - RNA, 1410 nt, Artificial Sequence; identical to SEQ ID NO: 77607
  derived and/or modified sequence opt1 from neuraminidase__InfluenzaA__AFH74535

SEQ ID NO: 83163 - RNA, 1410 nt, Artificial Sequence; identical to SEQ ID NO: 82643
  derived and/or modified sequence opt1 from neuraminidase__InfluenzaA__AFH74546

SEQ ID NO: 83164 - RNA, 1410 nt, Artificial Sequence; identical to SEQ ID NO: 82643
  derived and/or modified sequence opt1 from neuraminidase__InfluenzaA__AFH74557

SEQ ID NO: 83165 - RNA, 1410 nt, Artificial Sequence; identical to SEQ ID NO: 82643
  derived and/or modified sequence opt1 from neuraminidase__InfluenzaA__AFH74568

SEQ ID NO: 83166 - RNA, 1410 nt, Artificial Sequence; identical to SEQ ID NO: 82646
  derived and/or modified sequence opt1 from neuraminidase__InfluenzaA__AFH74579

SEQ ID NO: 83167 - RNA, 1410 nt, Artificial Sequence
  derived and/or modified sequence opt1 from neuraminidase__InfluenzaA__AFH74590
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugauguccguguga

SEQ ID NO: 83168 - RNA, 1410 nt, Artificial Sequence; identical to SEQ ID NO: 82643
  derived and/or modified sequence opt1 from neuraminidase__InfluenzaA__AFH74601

SEQ ID NO: 83169 - RNA, 1410 nt, Artificial Sequence
  derived and/or modified sequence opt1 from neuraminidase__InfluenzaA__AFH74612
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccuguccaacgugcacagcaacaacaccguccgcgaccggaccccguaccgcacgcugcucaugaacgagcugggcgugcccuuccaccugggcaccaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacgcaggaguccgagugcgugugcaucaacgggaccugcaccguggucaugaccgacgggagcgccagcggcaaggccgacacgaagauccucuucaucgaggagggcaagaucgugcacaccuccacccugagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcggccacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcacgagcgggaccuacggcaccggguccuggccggacggcgccgacaucaaccugaugcccaucuga

SEQ ID NO: 83170 - RNA, 1410 nt, Artificial Sequence; identical to SEQ ID NO: 82643
  derived and/or modified sequence opt1 from neuraminidase__InfluenzaA__AFH74623

SEQ ID NO: 83171 - RNA, 1410 nt, Artificial Sequence; identical to SEQ ID NO: 82643
  derived and/or modified sequence opt1 from neuraminidase__InfluenzaA__AFH74634

SEQ ID NO: 83172 - RNA, 1410 nt, Artificial Sequence; identical to SEQ ID NO: 82650
  derived and/or modified sequence opt1 from neuraminidase__InfluenzaA__AFH74645

SEQ ID NO: 83173 - RNA, 1410 nt, Artificial Sequence; identical to SEQ ID NO: 82650
  derived and/or modified sequence opt1 from neuraminidase__InfluenzaA__AFH74656

SEQ ID NO: 83174 - RNA, 1410 nt, Artificial Sequence; identical to SEQ ID NO: 82650
  derived and/or modified sequence opt1 from neuraminidase__InfluenzaA__AFH74667

SEQ ID NO: 83175 - RNA, 1410 nt, Artificial Sequence; identical to SEQ ID NO: 82650
  derived and/or modified sequence opt1 from neuraminidase__InfluenzaA__AFH74678

SEQ ID NO: 83176 - RNA, 1410 nt, Artificial Sequence; identical to SEQ ID NO: 77607
  derived and/or modified sequence opt1 from neuraminidase__InfluenzaA__AFH74689

SEQ ID NO: 83177 - RNA, 1410 nt, Artificial Sequence; identical to SEQ ID NO: 77607
  derived and/or modified sequence opt1 from neuraminidase__InfluenzaA__AFH74700

SEQ ID NO: 83178 - RNA, 1410 nt, Artificial Sequence
  derived and/or modified sequence opt1 from neuraminidase__InfluenzaA__AFH74711
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccugcguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucagcgagaagucccggcugggcuacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccguguga

SEQ ID NO: 83179 - RNA, 1410 nt, Artificial Sequence; identical to SEQ ID NO: 82643
  derived and/or modified sequence opt1 from neuraminidase__InfluenzaA__AFH74722

SEQ ID NO: 83180 - RNA, 1410 nt, Artificial Sequence; identical to SEQ ID NO: 82643
  derived and/or modified sequence opt1 from neuraminidase__InfluenzaA__AFH74733

SEQ ID NO: 83181 - RNA, 1410 nt, Artificial Sequence
  derived and/or modified sequence opt1 from neuraminidase__InfluenzaA__AFH74744
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcaacuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccguguga

SEQ ID NO: 83182 - RNA, 1410 nt, Artificial Sequence; identical to SEQ ID NO: 82643
  derived and/or modified sequence opt1 from neuraminidase__InfluenzaA__AFH74755

SEQ ID NO: 83183 - RNA, 1410 nt, Artificial Sequence; identical to SEQ ID NO: 82643
  derived and/or modified sequence opt1 from neuraminidase__InfluenzaA__AFH74766

SEQ ID NO: 83184 - RNA, 1410 nt, Artificial Sequence; identical to SEQ ID NO: 82643
  derived and/or modified sequence opt1 from neuraminidase__InfluenzaA__AFH74777

SEQ ID NO: 83185 - RNA, 1410 nt, Artificial Sequence; identical to SEQ ID NO: 77607
  derived and/or modified sequence opt1 from neuraminidase__InfluenzaA__AFH74788

SEQ ID NO: 83186 - RNA, 1410 nt, Artificial Sequence
  derived and/or modified sequence opt1 from neuraminidase__InfluenzaA__AFH74799
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcggccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccguguga

SEQ ID NO: 83187 - RNA, 1410 nt, Artificial Sequence; identical to SEQ ID NO: 82663
  derived and/or modified sequence opt1 from neuraminidase__InfluenzaA__AFH74810

SEQ ID NO: 83188 - RNA, 1410 nt, Artificial Sequence; identical to SEQ ID NO: 82663
  derived and/or modified sequence opt1 from neuraminidase__InfluenzaA__AFH74821

SEQ ID NO: 83189 - RNA, 1410 nt, Artificial Sequence; identical to SEQ ID NO: 82663
  derived and/or modified sequence opt1 from neuraminidase__InfluenzaA__AFH74832

SEQ ID NO: 83190 - RNA, 1410 nt, Artificial Sequence; identical to SEQ ID NO: 82663
  derived and/or modified sequence opt1 from neuraminidase__InfluenzaA__AFH74843

SEQ ID NO: 83191 - RNA, 1410 nt, Artificial Sequence; identical to SEQ ID NO: 82643
  derived and/or modified sequence opt1 from neuraminidase__InfluenzaA__AFH74854

SEQ ID NO: 83192 - RNA, 1410 nt, Artificial Sequence; identical to SEQ ID NO: 82643
  derived and/or modified sequence opt1 from neuraminidase__InfluenzaA__AFH74865

SEQ ID NO: 83193 - RNA, 1410 nt, Artificial Sequence; identical to SEQ ID NO: 82643
  derived and/or modified sequence opt1 from neuraminidase__InfluenzaA__AFH74876

SEQ ID NO: 83194 - RNA, 1410 nt, Artificial Sequence; identical to SEQ ID NO: 82643
  derived and/or modified sequence opt1 from neuraminidase__InfluenzaA__AFH74887

SEQ ID NO: 83195 - RNA, 1410 nt, Artificial Sequence; identical to SEQ ID NO: 82643
  derived and/or modified sequence opt1 from neuraminidase__InfluenzaA__AFH74898

SEQ ID NO: 83196 - RNA, 1410 nt, Artificial Sequence; identical to SEQ ID NO: 82643
  derived and/or modified sequence opt1 from neuraminidase__InfluenzaA__AFH74909

SEQ ID NO: 83197 - RNA, 1410 nt, Artificial Sequence
  derived and/or modified sequence opt1 from neuraminidase__InfluenzaA__AFH74920
augaaccccaaccagaagaucaucaccaucggcagcgugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggcuccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggggaccacggcgucaaggggugggccuucgacgacggcaacgacguguggauggggcgcaccaucagcgagaagucccggcugggcuacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcacguccggcaccuacgggaccggcagcuggccggacggggccgacaucaaccugaugcccaucuga

SEQ ID NO: 83198 - RNA, 1410 nt, Artificial Sequence; identical to SEQ ID NO: 77607
  derived and/or modified sequence opt1 from neuraminidase__InfluenzaA__AFH74931

SEQ ID NO: 83199 - RNA, 1410 nt, Artificial Sequence; identical to SEQ ID NO: 77607
  derived and/or modified sequence opt1 from neuraminidase__InfluenzaA__AFH74942

SEQ ID NO: 83200 - RNA, 1410 nt, Artificial Sequence; identical to SEQ ID NO: 82643
  derived and/or modified sequence opt1 from neuraminidase__InfluenzaA__AFH74953

SEQ ID NO: 83201 - RNA, 1410 nt, Artificial Sequence
  derived and/or modified sequence opt1 from neuraminidase__InfluenzaA__AFH74964
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcauccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccguguga

SEQ ID NO: 83202 - RNA, 1410 nt, Artificial Sequence; identical to SEQ ID NO: 82643
  derived and/or modified sequence opt1 from neuraminidase__InfluenzaA__AFH75391

SEQ ID NO: 83203 - RNA, 1410 nt, Artificial Sequence; identical to SEQ ID NO: 77746
  derived and/or modified sequence opt1 from neuraminidase__InfluenzaA__AFH97143

SEQ ID NO: 83204 - RNA, 1410 nt, Artificial Sequence
  derived and/or modified sequence opt1 from neuraminidase__InfluenzaA__AFI56407
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaaggggaacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacagcuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 83205 - RNA, 1410 nt, Artificial Sequence
  derived and/or modified sequence opt1 from neuraminidase__InfluenzaA__AFJ05141
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcagccugcugaugaacgagcucggcgugcccuuccaccugggcaccaagcaggucugcaucgccugguccagcuccagcugccacgacgggaaggccuggcugcacgugugcaucacgggcgacgacaagaacgcgaccgccuccuucaucuacaacgggcggcucguggacagcguggucuccuggagcaaggagauccugcgcacccaggaguccgagugcgugugcaucaacgggaccugcacgguggucaugaccgacgggagcgccagcggcaaggccgacaccaagauccuguucaucgaggagggcaagaucgugcacaccuccacgcucagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcggccacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgaccugaaccugaugcccaucuga

SEQ ID NO: 83206 - RNA, 1410 nt, Artificial Sequence
  derived and/or modified sequence opt1 from neuraminidase__InfluenzaA__AFJ05145
augaaccccaaccagaagaucaucaccaucggcagcgugucccugaccaugagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83207 - RNA, 1410 nt, Artificial Sequence
  derived and/or modified sequence opt1 from neuraminidase__InfluenzaA__AFJ05635
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcaugaagcuggccggcaacuccagccucugcccgguguccgggugggccaucuacagcaaggacaacuccauccggaucggcagcaagggcgacgucuucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggaggugcccagccccuacaacagccgcuucgaguccgucgccuggagcgcguccgccugccacgacggcaucaacuggcucaccaucgggaucagcggccccgacaacggcgccguggccgugcugaaguacaacgggaucaucaccgacaccaucaaguccuggcggaacaacauccugcgcacgcaggagagcgagugcgcgugcgucaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgugagcuccaacggcgccaacggggucaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgugggcaucaacgaguggagcggguacuccggcagcuucguccagcacccggagcugacggggcuggacugcauccggcccugcuucuggguggagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 83208 - RNA, 1410 nt, Artificial Sequence
  derived and/or modified sequence opt1 from neuraminidase__InfluenzaA__AFJ11709
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcugaucuga

SEQ ID NO: 83209 - RNA, 1410 nt, Artificial Sequence
  derived and/or modified sequence opt1 from neuraminidase__InfluenzaA__AFJ11720
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugaucgacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggacaagggcaaccgguccggguacagcggcaucuucuccguggagggcaagagcugcaucaaccgcugcuucuacgucgagcucauccgggggcgcaaggaggagaccgaggugcuguggaccagcaacuccaucguggucuucugcggcacgagcgggaccuacggcaccggguccuggccggacggcgccgaccugaaccucaugcccaucuga

SEQ ID NO: 83210 - RNA, 1410 nt, Artificial Sequence; identical to SEQ ID NO: 82151
  derived and/or modified sequence opt1 from neuraminidase__InfluenzaA__AFJ11731

SEQ ID NO: 83211 - RNA, 1410 nt, Artificial Sequence
  derived and/or modified sequence opt1 from neuraminidase__InfluenzaA__AFJ19845
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccgacguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccucgaccccaacaacgaggagggcgggcacggcgucaaggggugggccuucgacgacggcaacgacguguggauggggcgcaccaucaacgagaccagccggcugggcuacgagaccuucaaggucaucgagggcugguccaaccccaagagcaagcugcagaucaaccgccaggugaucguggacaaggggaaccgguccggcuacagcgggaucuucuccgucgagggcaagagcugcaucaaccgcugcuucuacguggagcucauccgggggcgcaaggaggagaccgaggugcuguggaccagcaacuccaucgucguguucugcggcacgagcggcaccuacgggaccggcuccuggccggacggggccgaccugaaccucaugcccaucuga

SEQ ID NO: 83212 - RNA, 1410 nt, Artificial Sequence; identical to SEQ ID NO: 77746
  derived and/or modified sequence opt1 from neuraminidase__InfluenzaA__AFJ44697

SEQ ID NO: 83213 - RNA, 1410 nt, Artificial Sequence; identical to SEQ ID NO: 81265
  derived and/or modified sequence opt1 from neuraminidase__InfluenzaA__AFJ69989

SEQ ID NO: 83214 - RNA, 1410 nt, Artificial Sequence
  derived and/or modified sequence opt1 from neuraminidase__InfluenzaA__AFJ69990
augaaccccaaccagaagaucaucaccaucggcagcgugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacagcggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 83215 - RNA, 1410 nt, Artificial Sequence
  derived and/or modified sequence opt1 from neuraminidase__InfluenzaA__AFJ69991
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaaccaggaccucagccacuccgccuggagcgcguccgccugccacgacgggaucaacuggcugaccaucggcaucagcggccccgacaacggggccguggccgugcugaaguacaacggcaucaucaccgacaccaucaaguccuggcggaacaacauccuccgcacgcaggagagcgagugcgcgugcgucaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccuggaguaccagaucggguacaucugcagcggcaucuucggggacaacccgcgccccaacgacaagaccggcuccugcggccccgugagcuccaacggggccaacggcgucaagggguucagcuucaaguacggcaacgggguguggaucggccggaccaagagcaucuccagccgcaagggcuucgagaugaucugggaccccaacggguggaccggcaccgacaacaacuucuccaucaagcaggacaucguggggaucaacgaguggagcggcuacuccgggagcuucguccagcacccggagcugacgggccucgacugcauccggcccugcuucuggguggagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 83216 - RNA, 1410 nt, Artificial Sequence; identical to SEQ ID NO: 78572
  derived and/or modified sequence opt1 from neuraminidase__InfluenzaA__AFJ69992

SEQ ID NO: 83217 - RNA, 1410 nt, Artificial Sequence
  derived and/or modified sequence opt1 from neuraminidase__InfluenzaA__AFJ69993
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucgugggccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggccggacggggccaaccugaaccucaugcccaucuga

SEQ ID NO: 83218 - RNA, 1410 nt, Artificial Sequence; identical to SEQ ID NO: 80526
  derived and/or modified sequence opt1 from neuraminidase__InfluenzaA__AFJ69994

SEQ ID NO: 83219 - RNA, 1413 nt, Artificial Sequence
  derived and/or modified sequence opt1 from neuraminidase__InfluenzaA__AFJ74389
augaaccccaaccagaagaucaucaccaucggcagcaucuccaucgccaucgggaucaucagccugauccuccagaucggcaacaucaucuccaucugggccagccacuccauccagaccgggagccagaaccacacgggcgugugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcgcauccuccggacccaggagagcgagugcgugugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgucaugugcgugugccgcgacaacuggcacgggagcaaccggcccuggguguccuucaaccagaaccuggacuaccagaucggcuacaucugcagcggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacagcgacuucuccaugaagcaggacaucguggccaugacggacuggagcggguacuccggcagcuucguccagcaccccgagcugaccggccuggacugcaugcggccgugcuucuggguggagcucgugcgcgggcugccccgggagaacaccaccaucuggacgagcggcuccagcaucuccuucugcggggucaacagcgacaccgccaacugguccuggcccgacggcgccgagcugcccuucaccaucgacaaguga

SEQ ID NO: 83220 - RNA, 1410 nt, Artificial Sequence
  derived and/or modified sequence opt1 from neuraminidase__InfluenzaA__AFJ74399
augaaccccaaccagaagaucaucaccaucggcagcgugucccugaccaucgccacgaucugcuuccucaugcagaucgccauccuggucaucacccugacccuccacuucaagcaguacgagugcaacagcccgcccaacaaccaggugaugcugugcgagcccaccaucaucgagcgcaacaucacggagaucguguaccugaccaacaccaccaucgagaaggagaucugccccaagcucgcggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccuggggcagggcaccacccucaacaaccgccacagcaacgacacggugcacgaccggaccccguaccgcacccugcugaugaacgagcucggcguccccuuccaccuggggaccaagcaggucugcaucgccugguccagcuccagcugccacgacggcaaggcguggcugcacgugugcgugacggggcacaacgagaacgccaccgccuccuucaucuacgacggccggcucguggacagcaucggguccuggagcaagaacauccugcgcacccaggaguccgagugcgugugcaucaacgggaccugcacggucgugaugaccgacggcagcgccuccgggcgggcggacaccaagauccuguucaucgaggagggcaagaucgugcacaucagcccccucagcggguccgcccagcacgucgaggagugcagcugcuacccccgcuacccgggcgugcggugcgugugccgcgacaacuggaagggcuccaaccggcccaucgucgacaucaacgugaaggacuucagcaucguguccagcuacgucugcuccgggcuggugggcgacacgccccgcaagaacgacagcuccagcuccagccacugccugaaccccaacaacgaggagggcggccacggggugaagggcugggccuucgacgacggcaacgacgucuggauggggcggaccaucuccgagaagcuccgcagcggcuacgagaccuucaaggugaucgggggcugguccaagccgaacagcaagcugcagaucaaccggcaggucaucguggaccgcgggaaccgguccggcuacagcggcaucuucuccguggagggcaagagcugcaucaaccgcugcuucuacgucgagcugauccgggggcgcaagcaggagaccgaggugugguggaccagcaacuccaucguggucuucugcgggacgagcggcaccuacgggaccggcuccuggcccgacggcgccgacaucaaccucaugcccaucuga

SEQ ID NO: 83221 - RNA, 1410 nt, Artificial Sequence
  derived and/or modified sequence opt1 from neuraminidase__InfluenzaA__AFJ74410
augaaccccaaccagaagaucaucaccaucggcagcgugucccugaccaucgccacgaucugcuuccucaugcagaucgccauccuggucaugaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccagcuccagcugccacgacggcaaggcguggcugcacgugugcgugacggggcacaacgagaacgccaccgccuccuucaucuacgacggccggcugguggacagcaucggguccuggagcaagaacauccuccgcacccaggaguccgagugcgucugcaucaacgggaccugcacgguggugaugaccgacggcagcgccuccgggcgggcggacaccaagauccuguucaucgaggagggcaagaucguccacaucagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucaucuccagcuacgucugcuccgggcucgugggcgacacgccccgcaagaacgacagcuccagcuccagccacugccugaaccccaacaacgaggagggcggccacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccggcaggucaucguggaccgcgggaaccgguccggcuacagcggcaucuucuccguggagggcaagagcugcaucaaccgcugcuucuacgucgagcugauccgggggcgcaagcaggagaccgaggugugguggaccagcaacuccaucguggucuucugcgggacgagcggcaccuacgggaccggcuccuggcccgacggcgccgacaucaaccugaugcccaucuga

SEQ ID NO: 83222 - RNA, 1410 nt, Artificial Sequence; identical to SEQ ID NO: 75323
  derived and/or modified sequence opt1 from neuraminidase__InfluenzaA__AFJ74451

SEQ ID NO: 83223 - RNA, 1413 nt, Artificial Sequence
  derived and/or modified sequence opt1 from neuraminidase__InfluenzaA__AFJ74462
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcagauccuccgcacccaggagagcgagugcgugugcgugaacggcuccugcuucaccaucaugacggacgggcccagcaaccgggccgccuccuaccgcaucuucaagaucgagaagggccgggucaccaagagcaucgagcuggacgccccgaacuaccacuacgaggagugcuccugcuaccccgacaccgggaccgugaugugcgugugccgcgacaacuggcacggcagcaaccggcccugggucuccuucaaccagaaccuggacuaccagaucggguacaucugcagcggcguguucggcgacaacccccgcccgaaggacggggagggcuccugcaaccccgugacggucgacggggcggacggcgugaagggguucagcuaccgguacggcaacggcguguggaucgggcgcaccaaguccaaccggcuccgcaagggcuucgagaugaucugggaccccaacggguggaccgacaccgacagcgacuucuccaugaagcaggacgucguggccaugacggacuggagcggcuacuccgggagcuucgugcagcaccccgagcugaccggccuggacugcaugcggccgugcuucugggucgagcucgugcgcggccugccccgggagaacaccaccaucuggacgagcggguccagcaucuccuucugcggcgucaacagcgagaccgccaacugguccuggcccgacggggccgagcugcccuucaccaucgacaaguga

SEQ ID NO: 83224 - RNA, 1410 nt, Artificial Sequence
  derived and/or modified sequence opt1 from neuraminidase__InfluenzaA__AFJ74517
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuacaugaccaacaccacgaucgagaaggagaucugccccaagcuggcggaguaccggaacugguccaagccgcagugcaagaucaccggguucgcccccuucagcaaggacaacuccauccgccugagcgccggcggggacaucugggugacccgggagcccuacguguccugcgaccccgacaagugcuaccaguucgcccucggccaggggaccacgcugaacaaccgccacagcaacgacaccguccacgaccggaccccguaccgcacccugcucaugaacgagcugggcgugcccuuccaccugggcacgaagcaggucugcaucgccugguccagcuccagcugccacgacgggaaggcguggcuccacgugugcgugaccggccacgacgagaacgccaccgccuccuucaucuacgacgggcggcugguggacagcaucggcuccuggagcaagaagauccugcgcacccaggaguccgagugcgucugcaucaacgggacgugcaccguggugaugaccgacggcagcgccuccggccgggcggacaccaagauccucuucaucgaggaggggaagaucguccacaucagccagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccuggugggggacacgccccgcaagaacgacagcuccagcuccagccacugccucaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacagcaagcugcagaucaaccgccaggugaucguggaccgggggaaccgguccggcuacagcgggaucuucuccgucgagggcaagagcugcaucaaccgcugcuucuacguggagcucauccggggccgcaagcaggagaacgaggugugguggaccagcaacuccaucgucguguucugcgggacgagcggcaccuacgggaccggcuccuggccggacggggccgacaucaaccugaugcccaucuga

SEQ ID NO: 83225 - RNA, 1410 nt, Artificial Sequence
  derived and/or modified sequence opt1 from neuraminidase__InfluenzaA__AFJ74564
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaccgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacgcaggaguccgagugcgucugcaucaacgggaccugcaccguggugaugaccgacggcagcgccuccgggaaggcggacacgaagauccuguucaucgaggagggcaagaucguccacaucagcacccugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcggccacggggucaagggcugggccuucgacgacggcaacgacguguggauggggcgcaccaucagcgagacccugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcacguccgggaccuacggcaccgggagcuggccggacggcgccgacaucaaccugaugcccaucuga

SEQ ID NO: 83226 - RNA, 1413 nt, Artificial Sequence
  derived and/or modified sequence opt1 from neuraminidase__InfluenzaA__AFJ74639
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcaugaacggcagcugcuucaccaucaugacggacgggcccuccaacggcgccgccagcuacaagaucuucaagaucgagaaggggaaggugaccaaguccaucgagcucaacgcccccagcuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 83227 - RNA, 1410 nt, Artificial Sequence
  derived and/or modified sequence opt1 from neuraminidase__InfluenzaA__AFJ74640
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccggguaccggaacuggagcaagccgcagugcaacaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccagcuccugccacgacggcaaggccuggcuccacgugugcgugaccggggacgacgagaacgcgaccgccagcuucaucuacaacggccgccugguggacuccaucgucagcugguccaagaagauccugcggacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgcuaccccgggguccggugcgugugccgcgacaacuggaagggcagcaaccggccgaucguggacaucaacaucaaggacuacuccaucgucagcuccuacgugugcagcggccuggugggggacacgccccgcaagaacgacuccagcuccagcucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggacaaggggaaccggagcggcuacuccgggaucuucagcgucgagggcaagagcugcaucaaccggugcuucuacguggagcucauccgcggccggaagcaggagaccgaggugcuguggaccuccaacagcaucgucguguucugcgggaccuccggcacguacgggaccggcagcuggccggacggggccgacaucaaccugaugcccaucuga

SEQ ID NO: 83228 - RNA, 1413 nt, Artificial Sequence; identical to SEQ ID NO: 83226
  derived and/or modified sequence opt1 from neuraminidase__InfluenzaA__AFJ74659

SEQ ID NO: 83229 - RNA, 1413 nt, Artificial Sequence
  derived and/or modified sequence opt1 from neuraminidase__InfluenzaA__AFJ74679
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcaugaacggcagcugcuucaccaucaugacggacgggcccuccaacggcgccgccagcuacaagaucuucaagaucgagaaggggaaggugaccaaguccaucgagcucaacgcccccagcuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacgacaacggcguguggaucgggcggaccaaguccaaccgccugcggaagggcuucgagaugaucugggaccccaacggguggaccaacaccgacagcgacuucuccgugaagcaggacgucguggccaucacggacuggagcggcuacagcggguccuucgugcagcaccccgagcucaccggccuggacugcauccgccccugcuucugggucgagcuggugcggggccucccgcgcgagaacaccaccaucuggacgagcggguccagcaucuccuucugcggcgucaacagcgacaccgccaacugguccuggcccgacggggccgagcugcccuucaccaucgacaaguga

SEQ ID NO: 83230 - RNA, 1410 nt, Artificial Sequence
  derived and/or modified sequence opt1 from neuraminidase__InfluenzaA__AFJ74680
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 83231 - RNA, 1410 nt, Artificial Sequence
  derived and/or modified sequence opt1 from neuraminidase__InfluenzaA__AFJ74701
augaaccccaaccagaagaucaucaccaucggcagcgugucccugaccaucgccacgaucugcuuccucaugcagaucgccauccuggucaccaccgugacccugcacuucaaccaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaucugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcauggccugguccagcuccagcugccacgacggcaaggcguggcugcacgucugcgugaccggggacgacgagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccaggugaaccgccaggugaucgucgagcggggcaaccgcagcggguacuccggcaucuucagcguggagggcaaguccugcaucaaccggugcuucuacguggagcugauccgcgggcggaaggaggagaccgaggucugguggaccagcaacagcaucgugguguucugcggcaccuccgggaccuacggcacggggagcuggccggacggcgccgacaucaaccugaugcccaucuga

SEQ ID NO: 83232 - RNA, 1410 nt, Artificial Sequence
  derived and/or modified sequence opt1 from neuraminidase__InfluenzaA__AFJ74731
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaccgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcacguccgggaccuacggcaccgggagcuggccggacggcgccgagaucaaccugaugcccaucuga

SEQ ID NO: 83233 - RNA, 1413 nt, Artificial Sequence; identical to SEQ ID NO: 83226
  derived and/or modified sequence opt1 from neuraminidase__InfluenzaA__AFJ74766

SEQ ID NO: 83234 - RNA, 1410 nt, Artificial Sequence
  derived and/or modified sequence opt1 from neuraminidase__InfluenzaA__AFJ74767
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 83235 - RNA, 1410 nt, Artificial Sequence; identical to SEQ ID NO: 83234
  derived and/or modified sequence opt1 from neuraminidase__InfluenzaA__AFJ74783

SEQ ID NO: 83236 - RNA, 1410 nt, Artificial Sequence; identical to SEQ ID NO: 75153
  derived and/or modified sequence opt1 from neuraminidase__InfluenzaA__AFJ74807

SEQ ID NO: 83237 - RNA, 1410 nt, Artificial Sequence; identical to SEQ ID NO: 75153
  derived and/or modified sequence opt1 from neuraminidase__InfluenzaA__AFJ74822

SEQ ID NO: 83238 - RNA, 1410 nt, Artificial Sequence; identical to SEQ ID NO: 75722
  derived and/or modified sequence opt1 from neuraminidase__InfluenzaA__AFJ74834

SEQ ID NO: 83239 - RNA, 1410 nt, Artificial Sequence; identical to SEQ ID NO: 75153
  derived and/or modified sequence opt1 from neuraminidase__InfluenzaA__AFJ74845

SEQ ID NO: 83240 - RNA, 1413 nt, Artificial Sequence
  derived and/or modified sequence opt1 from neuraminidase__InfluenzaA__AFJ75039
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgagcgugguggcggagaaggacaagaccuccgucacccuggccgggaacagcucccugugcagcaucuccggcugggccaucuacaccaaggacaacagcauccggaucggcuccaagggggacguguucgugauccgcgagccguucaucagcugcucccaccucgagugccggacguucuuccugacccagggcgcccugcucaacgacaagcacagcaacgggaccgucaaggaccgcucccccuaccgggcccugaugagcugcccccugggcgaggcgcccagcccguacaacuccaaguucgagagcguggccugguccgccagcgccugccacgacgggaugggcuggcucaccaucggcaucuccgggcccgacaacggcgcgguggccguccugaaguacaacgggaucaucacggagaccaucaagagcuggaagaagcgcauccugcggacccaggaguccgagugcgugugcaugaacggcagcugcuucaccaucaugacggacggccccuccaacgggggcgccagcuacaagaucuucaagaucgagaaggggaaggugaccaaguccaucgagcucaacgcccccaacuuccacuacgaggagugcagcugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcgaggggagcugcaacccggugacgaucgacggcgccgacggggugaagggcuucuccuacaaguacggcaacggggucuggaucggccggaccaagagcaaccgccugcggaagggguucgagaugaucugggaccccaacggcuggaccaacaccgacuccgacuucagcgugaagcaggacguggucgcgaucacggacuggagcggguacuccggcagcuucgugcagcaccccgagcucaccggccuggacugcauccgccccugcuucuggguggagcugguccgggggcucccgcgcgagaacaccaccaucuggacguccggcagcuccaucagcuucugcggggugaacuccgacaccgccaacuggagcuggcccgacggcgccgagcugcccuucaccaucgacaaguga

SEQ ID NO: 83241 - RNA, 1410 nt, Artificial Sequence
  derived and/or modified sequence opt1 from neuraminidase__InfluenzaA__AFJ75050
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcguccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccuggucgacuccaucgugagcugguccaaggagauccugcggacccaggagagcgagugcgugugcaucaacggcacgugcaccgucgugaugaccgacggguccgccagcggcaaggccgacaccaagauccucuucaucguggagggcaagaucguccacacgagcgcgcuguccgggagcgcccagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 83242 - RNA, 1410 nt, Artificial Sequence
  derived and/or modified sequence opt1 from neuraminidase__InfluenzaA__AFJ75094
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacgacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcuccaacugccucgaccccaacaacgaggagggcgggcacggggugaagggcugggccuucgacgacgggaacgacgucuggaugggccggaccaucagcgagaagucccgccugggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaucgaggugcuguggaccuccaacagcaucguggucuucugcggcaccuccgggaccuacggcacggggagcuggccggacggcgccgacaucaacaucaugcccaucuga

SEQ ID NO: 83243 - RNA, 1413 nt, Artificial Sequence
  derived and/or modified sequence opt1 from neuraminidase__InfluenzaA__AFJ75104
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccauccacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccggaggacggggagggcagcugcaaccccgugacgguggacggggcgaacggcgucaagggcuucuccuacaaguacgggaacggcguguggaucgggcggaccaagagcaaccgcauccggaagggcuucgagaugaucugggaccccaacggguggaccaacaccgacuccgacuucagcgugaagcaggacaucgucgccaucacggacugguccggcuacagcggcagcuucgugcagcaccccgagcugaccgggcucgacugcauccgcccgugcuucuggguggagcugguccggggccugccccgcgagaacaccaccaucuggacguccgggagcuccaucagcuucugcggcgugaacuccgacaucgccaacuggagcuggcccgacggcgccgagcuccccuucaccaucgacaaguga

SEQ ID NO: 83244 - RNA, 1410 nt, Artificial Sequence; identical to SEQ ID NO: 76892
  derived and/or modified sequence opt1 from neuraminidase__InfluenzaA__AFJ75114

SEQ ID NO: 83245 - RNA, 1410 nt, Artificial Sequence; identical to SEQ ID NO: 76892
  derived and/or modified sequence opt1 from neuraminidase__InfluenzaA__AFJ75452

SEQ ID NO: 83246 - RNA, 1410 nt, Artificial Sequence; identical to SEQ ID NO: 76892
  derived and/or modified sequence opt1 from neuraminidase__InfluenzaA__AFJ75463

SEQ ID NO: 83247 - RNA, 1413 nt, Artificial Sequence; identical to SEQ ID NO: 83243
  derived and/or modified sequence opt1 from neuraminidase__InfluenzaA__AFJ75552

SEQ ID NO: 83248 - RNA, 1413 nt, Artificial Sequence
  derived and/or modified sequence opt1 from neuraminidase__InfluenzaA__AFJ75574
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccauccacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaaggggcagauccugcggacccaggaguccgagugcgugugcaugaacggcagcugcuucaccaucaugacggacgggcccuccaacggcgccgccagcuacaagaucuucaagaucgagaaggggaaggugaccaaguccauggagcucaacgccccgaacuuccacuacgaggagugcagcugcuaccccgacaccggcaccgucaugugcgugugccgcgacaacuggcacggcuccaaccggcccugggugagcuucaaccagaaccuggacuaccagaucggguacaucugcuccggcgucuucggggacaacccccgcccggaggacggcgaggggagcugcaaccccgugacgguggacggcgcgaacggcgucaagggguucuccuacaaguacggcaacgggguguggaucggccggaccaagagcaaccgcauccggaagggguucgagaugaucugggaccccaacggcuggaccaacaccgacuccgacuucagcgugaagcaggacaucgucgccaucacggacugguccggcuacagcgggagcuucgugcagcaccccgagcugaccggccucgacugcauccgcccgugcuucuggguggagcugguccgggggcugccccgcgagaacaccaccaucuggacguccggcagcuccaucagcuucugcggcgugaacuccgacaucgccaacuggagcuggcccgacggggccgagcuccccuucaccaucgacaaguga

SEQ ID NO: 83249 - RNA, 1410 nt, Artificial Sequence; identical to SEQ ID NO: 76892
  derived and/or modified sequence opt1 from neuraminidase__InfluenzaA__AFJ75585

SEQ ID NO: 83250 - RNA, 1410 nt, Artificial Sequence
  derived and/or modified sequence opt1 from neuraminidase__InfluenzaA__AFJ75596
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcacgacccugaacaacgugcacuccaacaacaccguccgcgaccggaccccguaccgcacgcugcucaugaacgagcugggcgugcccuuccaccuggggaccaagcaggucugcaucgccuggagcuccagcuccugccacgacggcaaggccuggcuccacgugugcaucaccggggacgacaagaacgcgaccgccagcuucaucuacaacggccggcugguggacuccaucgugagcugguccaaggagauccugcgcacgcaggagagcgagugcgucugcaucaacgggaccugcaccguggugaugaccgacggcuccgccagcggcaaggccgacacgaagauccucuucaucgaggaggggaagaucguccacaccagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccaaguccaagcugcagaucaaccgccaggucaucguggaccgggggaaccgcagcggcuacuccgggaucuucagcguggagggcaagagcugcaucaaccggugcuucuacgucgagcucauccgcggccggaaggaggagaccgaggugcuguggaccuccaacagcaucguggucuucugcgggacguccggcaccuacgggaccggcagcuggccggacggggccgacaucaaccugaugcccaucuga

SEQ ID NO: 83251 - RNA, 1410 nt, Artificial Sequence
  derived and/or modified sequence opt1 from neuraminidase__InfluenzaA__AFJ75607
augaaccccacccagaagaucaucaccaucggcagcgugucccugacgaucagcaccaucugcuucuucaugcagaccgccauccucaucaccacggucacccugcacuucaagcaguacgaguucaacuccccgcccaacaaccaggugaugcugugcgagcccaccaucaucgagcgcaacaucaccgagaucguguaccucacgaacaccaccaucgagaaggagaucugccccaagcuggccgaguaccggaacuggagcaagccgcagugcgacaucaccggguucgcgcccuucuccaaggacaacagcauccgccuguccgccggcggggacaucugggucacgcgggagcccuacgugagcugcgaccccgagaagugcuaccaguucgcccucggccaggggaccacccugaacaacgugcacuccaacaacaccguccgcgaccggacgccguaccgcacccugcucaugaacgagcugggcgugcccuuccaccugggcaccaagcaggucugcaucgccuggagcuccagcuccugccacgacgggaaggccuggcuccacgugugcaucaccggcgacgacaagaacgcgacggccagcuucaucuacaacgggcggcugguggacuccaucgugagcugguccaaggagauccugcgcacccaggagagcgagugcgucugcaucaacgggaccugcaccguggugaugacggacggcuccgccagcggcaaggccgacaccaagauccucuucaucgaggagggcaagaucguccacaccagcaagcuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcggguccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgacaucaaccugaugcccaucuga

SEQ ID NO: 83252 - RNA, 1410 nt, Artificial Sequence
  derived and/or modified sequence opt1 from neuraminidase__InfluenzaA__AFJ75633
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaagaaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 83253 - RNA, 1413 nt, Artificial Sequence; identical to SEQ ID NO: 78469
  derived and/or modified sequence opt1 from neuraminidase__InfluenzaA__AFJ75654

SEQ ID NO: 83254 - RNA, 1410 nt, Artificial Sequence; identical to SEQ ID NO: 76892
  derived and/or modified sequence opt1 from neuraminidase__InfluenzaA__AFJ75665

SEQ ID NO: 83255 - RNA, 1413 nt, Artificial Sequence
  derived and/or modified sequence opt1 from neuraminidase__InfluenzaA__AFJ75676
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccauccacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccgaaggacggggagggcagcugcaaccccgugacgguggacggggcgaacggcgucaagggcuucuccuacaaguacgggaacggcguguggaucgggcggaccaagagcaaccgcauccggaagggcuucgagaugaucugggaccccaacggguggaccaacaccgacuccgacuucagcgugaagcaggacaucgucgccaucacggacugguccggcuacagcggcagcuucgugcagcaccccgagcugaccgggcucgacugcauccgcccgugcuucuggguggagcugguccggggccugccccgcgagaacaccaccaucuggacguccgggagcuccaucagcuucugcggcgugaacuccgacaucgccaacuggagcuggcccgacggcgccgagcuccccuucaccaucgacaaguga

SEQ ID NO: 83256 - RNA, 1413 nt, Artificial Sequence; identical to SEQ ID NO: 78469
  derived and/or modified sequence opt1 from neuraminidase__InfluenzaA__AFJ75687

SEQ ID NO: 83257 - RNA, 1410 nt, Artificial Sequence; identical to SEQ ID NO: 77746
  derived and/or modified sequence opt1 from neuraminidase__InfluenzaA__AFJ76122

SEQ ID NO: 83258 - RNA, 1410 nt, Artificial Sequence; identical to SEQ ID NO: 82324
  derived and/or modified sequence opt1 from neuraminidase__InfluenzaA__AFJ76134

SEQ ID NO: 83259 - RNA, 1410 nt, Artificial Sequence; identical to SEQ ID NO: 77746
  derived and/or modified sequence opt1 from neuraminidase__InfluenzaA__AFJ76146

SEQ ID NO: 83260 - RNA, 1410 nt, Artificial Sequence; identical to SEQ ID NO: 77746
  derived and/or modified sequence opt1 from neuraminidase__InfluenzaA__AFJ76159

SEQ ID NO: 83261 - RNA, 1410 nt, Artificial Sequence; identical to SEQ ID NO: 77746
  derived and/or modified sequence opt1 from neuraminidase__InfluenzaA__AFJ76173

SEQ ID NO: 83262 - RNA, 1410 nt, Artificial Sequence; identical to SEQ ID NO: 77746
  derived and/or modified sequence opt1 from neuraminidase__InfluenzaA__AFJ76191

SEQ ID NO: 83263 - RNA, 1413 nt, Artificial Sequence
  derived and/or modified sequence opt1 from neuraminidase__InfluenzaA__AFJ76192
augaaccccaaccagaagaucaucaccaucggcagcaucuccaucgccaucgggaucaucagccugauggugcagaucggcaacaucaucuccaucugggccagccacuccauccagaccgggauccagaacaacacgggcaucugcaaccagcgcaucaucaccuacgagaacagcaccugggucaaccacaccuacgugaacaucaacaacacgaacguggucgcgggggaggacaagaccuccgugacccucgccggcaacagcucccugugcagcaucuccggcugggccaucuacaccaaggacaacagcauccggaucggguccaagggcgacguguucgucauccgcgagccguucaucagcugcucccaccuggagugccggacguucuuccucacccagggggcccugcugaacgacaagcacagcaacggcaccgugaaggaccgcucccccuaccgggcccucaugagcugcccccugggggaggcgcccuccccguacaacagcaaguucgagagcguggccugguccgccagcgccugccacgacggcaugggcuggcugaccaucgggaucuccggccccgacaacggggcggucgccgugcucaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggucaccaaguccaucgagcugaacgcccccaacuucuacuacgaggagugcagcugcuacccggacaccggcaucgugaugugcgugugccgggacaacuggcacggguccaaccgccccugggucagcuucaaccagaaccucgacuaccagaucggcuacaucugcuccggcguguucggggacaacccccggcccgaggacggcgaggggagcugcaacccggugaccgucgacggcgcgaacggggugaagggcuucuccuacaaguacggcaacgggguguggaucggccgcaccaagagcaaccggcugcgcaagggguucgagaugaucugggaccccaacggcuggacgaacaccgacuccgacuucagcgucaagcaggacgugguggccaucaccgacugguccggguacagcggcagcuucguccagcaccccgagcugacgggccucgacugcauccggcccugcuucuggguggagcugguccgcgggcugccgcgggagaacaccaccaucuggaccuccggcagcuccaucagcuucugcggggugaacuccgacacggccaacuggagcuggcccgacggcgccgagcuccccuucaccaucgacaaguga

SEQ ID NO: 83264 - RNA, 1410 nt, Artificial Sequence; identical to SEQ ID NO: 77746
  derived and/or modified sequence opt1 from neuraminidase__InfluenzaA__AFJ76206

SEQ ID NO: 83265 - RNA, 1410 nt, Artificial Sequence
  derived and/or modified sequence opt1 from neuraminidase__InfluenzaA__AFJ76216
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucaagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 83266 - RNA, 1410 nt, Artificial Sequence
  derived and/or modified sequence opt1 from neuraminidase__InfluenzaA__AFJ77411
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacgacgagaacgcgaccgccuccuucaucuacgacggccggcuggucgacagcaucggguccuggagcaagaacauccuccgcacccaggaguccgagugcgugugcaucaacggcacgugcaccguggucaugaccgacggcagcgccuccgagcgggccgacaccaagauccuguucaucgaggaggggaagaucgugcacaucagcccccugagcggcuccgcgcagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaacgacagcuccagcuccagcuacugccugaaccccaacaacgaggagggcgggcacggcgugaaggggugggccuucgacgacggcaacgacgucuggaugggccggaccaucuccgagaagcugcgcagcggguacgagaccuucaaggugaucggcgggugguccaagccgaacagcaagcuccagaucaaccgccaggugaucgucgaccggggcaaccgguccggguacagcggcaucuucuccguggagggcaagagcugcgugaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccugaugcccaucuga

SEQ ID NO: 83267 - RNA, 1410 nt, Artificial Sequence
  derived and/or modified sequence opt1 from neuraminidase__InfluenzaA__AFJ77422
augaaccccaaccagaagaucaucaccaucggcagcgugucccugaccaucgccacgaucugcuuccucaugcagaucgccauccuggucaucaccgugacccugcacuucaagcaguacgagugcaacagcccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucagcgccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccagcuccagcugccacgacgggaaggcguggcugcacgugugcgugacgggccacgacgagaacgccaccgccuccuucaucuacgacgggcggcugguggacagcaucggcuccuggagcaagaagauccuccgcacccaggaguccgagugcgucugcaucaacgggaccugcacgguggugaugaccgacggcagcgccuccggccgggcggacaccaagauccuguucaucgaggaggggaagaucguccacaucagcccccugagcggcuccgcccagcacguggaggagugcagcugcuacccccgcuacuccggggugcggugcgucugccgcgacaacuggaagggcagcaaccggccgaucguggacaucaacgugaaggacuacuccaucgucagcuccuucgugugcagcggccucgugggggacacgccccgcaagaacgacuccagcuccagcucccacugccugaaccccaacaacgaggagggcgggcacggcgucaaggggugggccuucgacgacggcaacgacguguggaugggccggaccaucagcgagaagcugcgcuccggguacgagaccuucaaggucaucggcggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugugguggaccuccaacagcaucgucguguucugcggcacguccgggaccuacggcaccgggagcuggccggacggcgccgacaucaaccugaugcccaucuga

SEQ ID NO: 83268 - RNA, 1410 nt, Artificial Sequence
  derived and/or modified sequence opt1 from neuraminidase__InfluenzaA__AFJ77433
augaaccccaaccagaagaucaucaccaucggcagcgugucccugaccaucgccacgaucugcuuccucaugcagaucgucauccuggugaccaccgugacccugcacuucaagcaguacgagugcaacagcccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcgcccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacgacgagaacgcgaccgccuccuucaucuacgacggccggcuggucgacagcaucggguccuggagcaagaacauccuccgcacccaggaguccgagugcgugugcaucaacggcacgugcaccguggucaugaccgacggcagcgccuccgagcgggccgacaccaagauccuguucaucgaggaggggaagaucgugcacaucagcccccugagcggcuccgcgcagcacguggaggagugcagcugcuacccccgcuacccggggguccggugcgugugccgcgacaacuggaagggcuccaaccggcccaucguggacaucaacgucaaggacuacagcaucguguccagcuacgugugcuccggccucgucggggacacgccccgcaagaccgacagcuccagcuccagcgacugccugaaccccaacaacgaggagggcgggcacggcgugaaggggugggccuucgacgacggcaacgacgucuggaugggccggaccaucuccgagaagcugcgcagcggguacgagaccuucaaggugaucggcgggugguccaagccgaacagcaagcuccagaucaaccgccaggugaucgucgaccggggcaaccgguccggguacagcggcaucuucuccguggagggcaagagcugcgugaaccgcugcuucuacgucgagcugauccgggggcgcaagcaggagacggaggugugguggaccagcaacuccaucguggucuucugcggcaccagcgggaccuacggcacgggguccuggcccgacggcgccgacaucaaccugaugcccaucuga

SEQ ID NO: 83269 - RNA, 1410 nt, Artificial Sequence
  derived and/or modified sequence opt1 from neuraminidase__InfluenzaA__AFJ77443
augaaccccaaccagaagaucaucaccaucggcagcgugucccugaccaucgccacgaucugcuuccucaugcagaucgccauccuggucaucacccugacccuccacuucaagcaguacgagugcaacagcccgcccaacaaccaggugaugcugugcgagcccaccaucaucgagcgcaacaucacggagaucguguaccugaccaacaccaccaucgagaaggagaucugccccaagcucgcggaguaccggaacugguccaagccgcagugcaagaucacgggguucgcccccuucagcaaggacaacuccauccgccugagcgccggcggggacaucugggucacccgggagcccuacguguccugcgaccccggcaagugcuaccaguucgcccuggggcagggcaccacccucaacaaccgccacagcaacgacacggugcacgaccggaccccguaccgcacccugcugaugaacgagcucggcguccccuuccaccuggggaccaagcaggucugcaucgccugguccagcuccagcugccacgacggcaaggcguggcugcacgugugcgugacggggcacaacgagaacgccaccgccuccuucaucuacgacggccggcucguggacagcaucggguccuggagcaagaacauccugcgcacccaggaguccgagugcgugugcaucaacgggaccugcacggucgugaugaccgacggcagcgccuccgggcgggcggacaccaagauccuguucaucgaggagggcaagaucgugcacaucagcccccucagcggguccgcccagcacgucgaggagugcagcugcuacccccgcuacccgggcgugcggugcgugugccgcgacaacuggaagggcuccaaccggcccaucgucgacaucaacgugaaggacuucagcaucguguccagcuacgucugcuccgggcuggugggcgacacgccccgcaagaacgacagcuccagcuccagccacugccugaaccccaacaacgaggagggcggcaacggggugaagggcugggccuucgacgacggcaacgacgucuggauggggcggaccaucuccgagaagcuccgcagcggcuacgagaccuucaaggugaucgggggcugguccaagccgaacagcaagcugcagaucaaccggcaggucaucguggaccgcgggaaccgguccggcuacagcggcaucuucuccguggagggcaagagcugcaucaaccgcugcuucuacgucgagcugauccgggggcgcaagcaggagaccgaggugugguggaccagcaacuccaucguggucuucugcgggacgagcggcaccuacgggaccggcuccuggcccgacggcgccgacaucaaccucaugcccaucuga

SEQ ID NO: 83270 - RNA, 1410 nt, Artificial Sequence
  derived and/or modified sequence opt1 from neuraminidase__InfluenzaA__AFJ77465
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaaccgccacuccaacgacaccguccacgaccggacccccuaccgcacccuccugaugaacgagcugggcgugcccuuccaccucggcacgaagcaggucugcaucgccuggagcuccagcuccugccacgacgggaaggcguggcugcacgugugcgugaccggccacgacgagaacgccaccgccagcuucaucuacgacgggcggcugguggacuccaucggcagcugguccaagaagauccuccgcacccaggagagcgagugcgucugcaucaacgggacgugcaccguggugaugaccgacggcuccgccagcggccgggcggacaccaagauccuguucaucgaggaggggaagaucguccacaucagcccccuguccggcagcgcccagcacguggaggagugcuccugcuacccgcgcuaccccggggugcggugcgucugccgcgacaacuggaagggcagcaaccggcccaucguggacaucaacgugaagaacuacuccaucgucagcuccuacgugugcagcggccucgugggggacacgccccgcaagaacgacuccagcuccagcucccacugccugaacccgaacaacgaggagggcgggcacggcgucaaggggugggccuucgacgacggcaacgacguguggaugggccggaccaucagcgagaagcugcgcuccggguacgagaccuucaaggucaucgagggcuggagcaagcccaacuccaagcuccagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggggccgacaucaaccugaugcccaucuga

SEQ ID NO: 83271 - RNA, 1410 nt, Artificial Sequence
  derived and/or modified sequence opt1 from neuraminidase__InfluenzaA__AFJ77476
augaaccccaaccagaagaucaucaccaucggcagcgugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugagcgccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccagcuccagcugccacgacgggaaggcguggcugcacgugugcgugaccggccacgacgagaacgccaccgccuccuucaucuacgggggccggcucguggacagcaucggguccuggagcaagaagauccugcgcacccaggaguccgagugcgucugcaucaacggcacgugcaccguggugaugaccgacggcagcgccuccgggcgggcggacaccaagauccuguucaucgaggagggcaagaucauccacaucagccagcucagcggguccgcccagcacgucgaggagugcagcugcuacccccgcuaccccggcgugcggugcgugugccgcgacaacuggaagggcuccaaccggcccaucgucgacaucaacgugaaggacuacagcaucguguccagcuacgucugcuccgggcuggugggcgacacgccgcgcaagaacgacagcuccagcuccagccacugccuggaccccaacaacgaggagggcgggcacggggugaagggcugggccuucgacgacggcaacgacgucuggauggggcggaccaucuccgagaaguuccgcagcggcuacgagaccuucaaggugaucgaggggugguccaagcccaacagcaagcuccagaucaaccggcagaucaucgucgaccgcgacaaccgguccggcuacagcgggaucuucuccguggagggcaagagcugcaucaaccgcugcuucuacguggagcugauccggggccgcaagcaggagaccgaggucugguggacgagcaacuccaucgugguguucugcgggaccagcggcaccuacgggaccggcuccuggcccgacggggccgacaucaaccugaugccgaucuga

SEQ ID NO: 83272 - RNA, 1410 nt, Artificial Sequence; identical to SEQ ID NO: 75323
  derived and/or modified sequence opt1 from neuraminidase__InfluenzaA__AFJ77487

SEQ ID NO: 83273 - RNA, 1410 nt, Artificial Sequence
  derived and/or modified sequence opt1 from neuraminidase__InfluenzaA__AFJ77498
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacacgagcaagcugagcggcuccgcccagcacguggaggagugcagcugcuacccccgcuaccccggggugcggugcgucugccgcgacaacuggaagggcuccaaccggccgaucguggacaucaacgugaaggacuacagcaucaucuccagcuacgucugcuccggccucgugggggacacgccccgcaagaacgacagcuccagcuccagccacugccuggaccccaacaacgaggagggcgggcacggcgugaaggggugggccuucgacgacggcaacgacgucuggaugggccggaccaucuccgagaagucccgcagcggguacgagaccuucaaggugaucgagggcuggagcaagcccaacuccaagcugcagaucaaccggcaggucaucguggagcgcgggaacaugagcggcuacuccgggaucuucagcguggagggcaagagcugcaucaaccggugcuucuacgucgagcucauccgcggccggaagcaggagaccgaggugugguggaccuccaacagcaucguggucuucugcgggaccuccggcaccuacgggacgggcagcuggccggacggggccgacaucaaccugaugcccaucuga

SEQ ID NO: 83274 - RNA, 1410 nt, Artificial Sequence; identical to SEQ ID NO: 75323
  derived and/or modified sequence opt1 from neuraminidase__InfluenzaA__AFJ77509

SEQ ID NO: 83275 - RNA, 1410 nt, Artificial Sequence
  derived and/or modified sequence opt1 from neuraminidase__InfluenzaA__AFJ77520
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaucgaggugcuguggaccuccaacagcaucgucguguucugcggcaccuccgggaccuacggcaccgggagcuggccggacggcgccgacaucaaccucaugcccaucuga

SEQ ID NO: 83276 - RNA, 1410 nt, Artificial Sequence
  derived and/or modified sequence opt1 from neuraminidase__InfluenzaA__AFJ77531
augaaccccaaccagaagaucaucaccaucggcagcgugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaaggugaccggguucgcgcccuucagcaaggacaacuccauccgccucagcgccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccagcuccagcugccacgacggcaaggccuggcugcacgugugcgugaccgggcacaacgagaacgcgaccgccuccuucaucuacgacggccggcuggucgacagcaucggguccuggagcaagaacauccuccgcacccaggaguccgagugcgugugcaucaacggcacgugcaccguggucaugaccgacggcagcgccuccgggcgggccgacaccaagauccuguucaucgaggagggcaagaucgugcacaucagcccccugagcggguccgcgcagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcucgucggcgacacgccccgcaagaacgacagcuccagcuccagcuacugccuggaccccaacaacgaggagggcgggcacggggugaagggcugggccuucgacgacggcaacgacgucuggauggggcggaccaucuccgagaagcugcgcagcggcuacgagaccuucaaggugaucgggggcugguccaagccgaacagcaagcuccagaucaaccgccaggugaucgucgaccgggggaaccgguccggcuacagcggcaucuucuccguggagggcaagagcugcaucaaccgcugcuucuacguggagcugauccgggggcgcaagcaggagaccgaggucugguggacgagcaacuccaucgugguguucugcgggaccagcggcaccuacgggaccggcuccuggcccgacggcgccgacaucaaccugaugcccaucuga

SEQ ID NO: 83277 - RNA, 1410 nt, Artificial Sequence
  derived and/or modified sequence opt1 from neuraminidase__InfluenzaA__AFJ77542
augaaccccaaccagaagaucaucaccaucggcagcgugucccugaccaucagcacgaucugcuuccucaugcagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggccgaguaccggaacuggagcaagccgcagugcaacaucaccggguucgcgcccuucuccaaggacaacagcauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccagcuccugccacgacggcaaggccuggcugcacgugugcgugaccggggacgacgagaacgcgaccgccagcuucaucuacaacggccgccugguggacuccaucgggagcugguccaagaagauccuccggacccaggagagcgagugcgucugcaucaacggcacgugcaccguggugaugaccgacggcuccgccagcgggaaggccgacaccaagauccuguucaucgaggagggcaagaucguccacacgagcacccuguccgggagcgcgcagcacguggaggagugcuccugcuacccccgcuaccccggcgugcggugcgucugccgcgacaacuggaagggcagcaaccggccgaucguggacaucaacaucaaggacuacuccaucgugagcuccuacgucugcagcgggcucgugggcgacacgccccgcaagaacgacuccagcuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggaccgcggcaaccggagcggguacuccggcaucuucagcguggagggcaagagcugcaucaaccgcugcuucuacgucgagcugauccgggggcgcaagcaggagaccgaggugcuguggaccuccaacagcaucguggucuucugcggcaccuccgggacguacggcaccgggagcuggccggacggcgccgacaucaaccucaugcccaucuga

SEQ ID NO: 83278 - RNA, 1410 nt, Artificial Sequence; identical to SEQ ID NO: 75261
  derived and/or modified sequence opt1 from neuraminidase__InfluenzaA__AFJ77553

SEQ ID NO: 83279 - RNA, 1410 nt, Artificial Sequence
  derived and/or modified sequence opt1 from neuraminidase__InfluenzaA__AFJ77564
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagccagcugagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccucgugggggacacgccccgcaagaacgacagcuccagcuccagccacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacagcaagcuccagaucaaccgccaggugaucguggaccgggggaaccgguccggcuacagcgggaucuucuccgucgagggcaagagcugcaucaaccgcugcuucuacguggagcugauccggggccgcaagcaggagaacgaggugugguggaccagcaacuccaucgucguguucugcgggacgagcggcaccuacgggaccggcuccuggccggacggggccgacaucaaccugaugcccaucuga

SEQ ID NO: 83280 - RNA, 1329 nt, Artificial Sequence
  derived and/or modified sequence opt1 from neuraminidase__InfluenzaA__AFJ77575
augaaccccaaccagaagaucaucaccaucggcagcgugucccugaccaucgccacgaucugcuuccucaugcagaucgccauccuggucaucgagcgcaacaucaccgagaucguguaccugaccaacaccacgaucgagaaggagaucugcccgaagcucgcggaguaccggaacuggagcaagccccagugcaacaucaccggguucgcccccuucuccaaggacaacagcauccgccuguccgccggcggggacaucugggugacccgggagcccuacgucagcugcgacccggacaagugcuaccaguucgcccugggccaggggaccacgcucaacaacggccacuccaacgacaccgugcacgaccgcacccccuaccggacccugcugaugaacgagcucggcgugcccuuccaccuggggacgaagcaggucugcaucgccuggagcuccagcuccugccacgacggcaaggcguggcugcacgugugcgugaccggggacgacgagaacgccaccgccagcuucaucuacaacggccgccucgucgacuccaucgggagcugguccaagaagauccugcggacccaggagagcgagugcgugugcaucaacggcacgugcaccguggucaugaccgacggcuccgccagcgggaaggcggacaccaagauccuguucaucgaggagggcaagaucgugcacacguccagccucagcggguccgcccagcacguggaggagugcagcugcuacccccgcuacccgggcguccggugcgugugccgcgacaacuggaagggcuccaaccggcccaucguggacaucaacgucaaggacuacagcaucguguccagcuacgugugcuccgggcuggucggcgacacgccccgcaagaacgacagcuccagcuccagccacugccuggaccccaacaacgaggagggcgggcacggggugaagggcugggccuucgacgacggcaacgacguguggauggggcggaccaucuccgagaagcuccgcagcggcuacgagaccuucaaggucaucgaggggugguccaagccgaacagcaagcugcagaucaaccgccaggugaucgucgaccggggcaaccgguccggguacagcggcaucuucuccguggagggcaagagcugcaucaaccgcugcuucuacguggagcugauccgggggcgcaagcaggagaccgagguccucuggaccagcaacuccaucgugguguucugcggcaccagcgggaccuacggcacgggguccuggcccgacggcgccgacaucaaccugaugcccaucuga

SEQ ID NO: 83281 - RNA, 1410 nt, Artificial Sequence
  derived and/or modified sequence opt1 from neuraminidase__InfluenzaA__AFJ77597
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgcgcccccugagcgggagcgcccagcacguggaggagugcuccugcuacccccgguacccgggcgugcgcugcgucugccgggacaacuggaagggcagcaaccgccccaucguggacaucaacgugaaggacuacuccaucgucagcuccuacgugugcagcgggcucgugggcgacacgccccggaagaacgacuccagcuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagccgaacuccaagcuccagaucaaccgccaggugaucguggaccggggcaaccgcagcggguacuccggcaucuucagcgucgagggcaaguccugcaucaaccggugcuucuacguggagcugauccgcgggcggaagcaggagaccgaggugcuguggaccagcaacagcaucgucguguucugcggcaccuccgggaccuacggcacggggagcuggcccgacggcgccgacaucaaccucaugcccaucuga

SEQ ID NO: 83282 - RNA, 1410 nt, Artificial Sequence
  derived and/or modified sequence opt1 from neuraminidase__InfluenzaA__AFJ77608
augaaccccaaccagaagaucaucaccaucggcagcgugucccugaccaucgccacgaucugcuuccucaugcagaccgccauccuggucaccaccgugacgcugcacuucaagcaguacgagugcaacagcccgcccaacaaccaggugaugcucugcgagcccaccaucaucgagcgcaacaugaccgagaucgucuaccugaccaacacgaccaucgagaaggagaucugccccaagcuggcggaguaccggaacugguccaagccgcagugcaacaucaccggguucgcccccuucagcaaggacaacuccauccgccucagcgccggcggggaccugugggugacccgggagcccuacguguccugcgaccccgacaagugcuaccaguucgcccugggccaggggacgacccucaacaacggccacagcaacgacaccguccacgaccgcaccccguaccggacgcugcugaugaacgagcucggcgugcccuuccaccuggggaccaagcaggucugcaucgccugguccagcuccagcugccacgacggcaaggcguggcugcacgugugcgugaccggggacgacgagaacgccaccgccuccuucaucuacaacggccgccucguggacagcaucggguccuggagcaagaagauccugcggacgcaggaguccgagugcgucugcaucaacgggaccugcaccguggugaugaccgacggcagcgccuccgggaaggcggacacgaagauccuguucaucgaggagggcaagaucguccacaccagcagccucuccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcuggugggcgacacgccccgcaagaacgacuccagcuccagcucccacugccuggaccccaacaacgaggagggcggccacggggucaagggcugggccuucgacgacggcaacgacguguggauggggcggaccaucagcgagaagcuccgcuccggcuacgagaccuucaaggucaucgagggguggagcaagcccaacuccaagcugcagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcucuggaccuccaacagcaucgucguguucugcggcaccuccgggacguacggcaccgggagcuggccggacggcgccgacaucaaccugaugcccaucuga

SEQ ID NO: 83283 - RNA, 1410 nt, Artificial Sequence; identical to SEQ ID NO: 83281
  derived and/or modified sequence opt1 from neuraminidase__InfluenzaA__AFJ77619

SEQ ID NO: 83284 - RNA, 1410 nt, Artificial Sequence; identical to SEQ ID NO: 83281
  derived and/or modified sequence opt1 from neuraminidase__InfluenzaA__AFJ77630

SEQ ID NO: 83285 - RNA, 1410 nt, Artificial Sequence; identical to SEQ ID NO: 83277
  derived and/or modified sequence opt1 from neuraminidase__InfluenzaA__AFJ77641

SEQ ID NO: 83286 - RNA, 1410 nt, Artificial Sequence; identical to SEQ ID NO: 83277
  derived and/or modified sequence opt1 from neuraminidase__InfluenzaA__AFJ77652

SEQ ID NO: 83287 - RNA, 1410 nt, Artificial Sequence; identical to SEQ ID NO: 75048
  derived and/or modified sequence opt1 from neuraminidase__InfluenzaA__AFJ77663

SEQ ID NO: 83288 - RNA, 1410 nt, Artificial Sequence; identical to SEQ ID NO: 75048
  derived and/or modified sequence opt1 from neuraminidase__InfluenzaA__AFJ77674

SEQ ID NO: 83289 - RNA, 1410 nt, Artificial Sequence; identical to SEQ ID NO: 75048
  derived and/or modified sequence opt1 from neuraminidase__InfluenzaA__AFJ77685

SEQ ID NO: 83290 - RNA, 1410 nt, Artificial Sequence
  derived and/or modified sequence opt1 from neuraminidase__InfluenzaA__AFJ77696
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgagaaggcggacaccaagauccuguucaucgaggaggggaagaucguccacacgagccugcucagcggcuccgcccagcacguggaggagugcagcugcuacccccgcuaccccggggugcggugcgucugccgcgacaacuggaagggcuccaaccggccgaucguggacaucaacgugaaggacuacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucuccgagaagcuccgcagcggguacgagaccuucaaggucaucgagggcugguccaagcccaacagcaagcugcagaucaaccgccaggugaucguggaccgggggaaccgguccggcuacagcgggaucuucuccgucgagggcaagagcugcaucaaccgcugcuucuacguggagcugauccggggccgcaagcaggagaccgaggugcucuggaccagcaacuccaucgucguguucugcgggaccagcggcaccuacgggacgggcuccuggccggacggggccgacaucaaccugaugcccaucuga

SEQ ID NO: 83291 - RNA, 1410 nt, Artificial Sequence; identical to SEQ ID NO: 75048
  derived and/or modified sequence opt1 from neuraminidase__InfluenzaA__AFJ77707

SEQ ID NO: 83292 - RNA, 1410 nt, Artificial Sequence; identical to SEQ ID NO: 75069
  derived and/or modified sequence opt1 from neuraminidase__InfluenzaA__AFJ77718

SEQ ID NO: 83293 - RNA, 1410 nt, Artificial Sequence; identical to SEQ ID NO: 75069
  derived and/or modified sequence opt1 from neuraminidase__InfluenzaA__AFJ77729

SEQ ID NO: 83294 - RNA, 1410 nt, Artificial Sequence
  derived and/or modified sequence opt1 from neuraminidase__InfluenzaA__AFJ77740
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaucguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 83295 - RNA, 1410 nt, Artificial Sequence
  derived and/or modified sequence opt1 from neuraminidase__InfluenzaA__AFJ77751
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccgcgaccggaccccguaccgcacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgcuaccccggcgugcggugcgucugccgcgacaacuggaagggcuccaaccggccgaucguggacaucaacgugaaggacuacagcaucuucuccagcuacgucugcuccgggcucgugggcgacacgccccgcaagaacgacagcuucuccagcucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggagcaagcccaacuccaagcuccagaucaaccggcaggucaucguggagcgcggcaaccggagcggguacuccggcaucuucagcguggagggcaaguccugcaucaaccgcugcuucuacgucgagcugauccgggggcgcaaggaggagaccgaggugugguggaccagcaacagcaucguggucuucugcggcaccuccgggaccuacggcacggggagcuggccggacggcgccgacaucaaccugaugcccaucuga

SEQ ID NO: 83296 - RNA, 1410 nt, Artificial Sequence; identical to SEQ ID NO: 75153
  derived and/or modified sequence opt1 from neuraminidase__InfluenzaA__AFJ77762

SEQ ID NO: 83297 - RNA, 1410 nt, Artificial Sequence; identical to SEQ ID NO: 75153
  derived and/or modified sequence opt1 from neuraminidase__InfluenzaA__AFJ77773

SEQ ID NO: 83298 - RNA, 1410 nt, Artificial Sequence; identical to SEQ ID NO: 75153
  derived and/or modified sequence opt1 from neuraminidase__InfluenzaA__AFJ77784

SEQ ID NO: 83299 - RNA, 1410 nt, Artificial Sequence; identical to SEQ ID NO: 75722
  derived and/or modified sequence opt1 from neuraminidase__InfluenzaA__AFJ77795

SEQ ID NO: 83300 - RNA, 1410 nt, Artificial Sequence; identical to SEQ ID NO: 75722
  derived and/or modified sequence opt1 from neuraminidase__InfluenzaA__AFJ77806

SEQ ID NO: 83301 - RNA, 1410 nt, Artificial Sequence; identical to SEQ ID NO: 75722
  derived and/or modified sequence opt1 from neuraminidase__InfluenzaA__AFJ77817

SEQ ID NO: 83302 - RNA, 1410 nt, Artificial Sequence; identical to SEQ ID NO: 75722
  derived and/or modified sequence opt1 from neuraminidase__InfluenzaA__AFJ77828

SEQ ID NO: 83303 - RNA, 1410 nt, Artificial Sequence
  derived and/or modified sequence opt1 from neuraminidase__InfluenzaA__AFJ77839
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 83304 - RNA, 1410 nt, Artificial Sequence
  derived and/or modified sequence opt1 from neuraminidase__InfluenzaA__AFJ77850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccaaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 83305 - RNA, 1410 nt, Artificial Sequence; identical to SEQ ID NO: 75722
  derived and/or modified sequence opt1 from neuraminidase__InfluenzaA__AFJ77861

SEQ ID NO: 83306 - RNA, 1410 nt, Artificial Sequence; identical to SEQ ID NO: 75722
  derived and/or modified sequence opt1 from neuraminidase__InfluenzaA__AFJ77872

SEQ ID NO: 83307 - RNA, 1410 nt, Artificial Sequence; identical to SEQ ID NO: 76188
  derived and/or modified sequence opt1 from neuraminidase__InfluenzaA__AFJ77883

SEQ ID NO: 83308 - RNA, 1410 nt, Artificial Sequence; identical to SEQ ID NO: 75722
  derived and/or modified sequence opt1 from neuraminidase__InfluenzaA__AFJ77894

SEQ ID NO: 83309 - RNA, 1410 nt, Artificial Sequence; identical to SEQ ID NO: 75722
  derived and/or modified sequence opt1 from neuraminidase__InfluenzaA__AFJ77905

SEQ ID NO: 83310 - RNA, 1410 nt, Artificial Sequence
  derived and/or modified sequence opt1 from neuraminidase__InfluenzaA__AFJ77916
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucaucgucuucugcggcaccuccgggacguacggcaccgggagcuggccggacggcgccgacaucaaccugaugcccaucuga

SEQ ID NO: 83311 - RNA, 1410 nt, Artificial Sequence; identical to SEQ ID NO: 75744
  derived and/or modified sequence opt1 from neuraminidase__InfluenzaA__AFJ77927

SEQ ID NO: 83312 - RNA, 1410 nt, Artificial Sequence; identical to SEQ ID NO: 75744
  derived and/or modified sequence opt1 from neuraminidase__InfluenzaA__AFJ77938

SEQ ID NO: 83313 - RNA, 1410 nt, Artificial Sequence; identical to SEQ ID NO: 75722
  derived and/or modified sequence opt1 from neuraminidase__InfluenzaA__AFJ77949

SEQ ID NO: 83314 - RNA, 1410 nt, Artificial Sequence; identical to SEQ ID NO: 75722
  derived and/or modified sequence opt1 from neuraminidase__InfluenzaA__AFJ77960

SEQ ID NO: 83315 - RNA, 1410 nt, Artificial Sequence
  derived and/or modified sequence opt1 from neuraminidase__InfluenzaA__AFJ77971
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggacgagaccgaggugcuguggaccuccaacagcaucgucguguucugcggcaccuccgggacguacggcaccgggagcuggccggacggcgccgacaucaaccugaugcccaucuga

SEQ ID NO: 83316 - RNA, 1410 nt, Artificial Sequence
  derived and/or modified sequence opt1 from neuraminidase__InfluenzaA__AFJ77982
augaaccccaaccagaagaucaucaccaucggcuucgugagccugaccaucuccacgaucugcuucuucaugcagaucgccauccucaucaccaccgucccgcugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccccagugcaacaucacgggguucgcgcccuucagcaaggacaacuccauccgccugagcgccggcggggacaucugggucacccgggagcccuacguguccugcgacccggacaagugcuaccaguucgcccucggccaggggaccacccugaacaacgugcacagcaacgacacgguccacgaccgcacccccuaccggacccugcucaugaacgagcugggcgugcccuuccaccugggcaccaagcaggucugcaucgccugguccagcuccagcugccacgacgggaaggccuggcuccacgugugcgugacgggcgacgacaagaacgcgaccgccuccuucaucuacaacgggcgccugguggacagcaucgucuccuggagcaaggagauccugcggacccaggaguccgagugcgugugcaucaacgggaccugcacgguggucaugaccgacgggagcgccuccggcaaggccgacaccaagauccucuucaucgaggagggcaagaucgugcacaccagcacgcugagcggguccgcgcagcacguggaggagugcagcugcuacccccgcuacccgggcguccggugcgugugccgcgacaacuggaagggguccaaccggcccaucguggacaucaacaucaaggacuacagcaucgucuccagcuacgugugcuccggcaucgugggcgacacgccccgcaagaacgacagcuccagcuccagccacugccuggaccccaacaacgaggagggcggccacggggucaagggcugggccuucgacgacgggaacgacguguggaugggccggaccaucuccgagaagcuccgcagcggcuacgagaccuucaaggucaucgaggggugguccaacccgaacagcaagcugcagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcaccagcgggaccuacggcacgggguccuggcccgacggcgccgacaucaaccugaugcccaucuga

SEQ ID NO: 83317 - RNA, 1410 nt, Artificial Sequence; identical to SEQ ID NO: 75720
  derived and/or modified sequence opt1 from neuraminidase__InfluenzaA__AFJ77993

SEQ ID NO: 83318 - RNA, 1410 nt, Artificial Sequence
  derived and/or modified sequence opt1 from neuraminidase__InfluenzaA__AFJ78004
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggagcaagccgcagugcaacaucaccggguucgcgcccuucuccaaggacaacagcauccggcuguccgccggcggggacaucugggucacccgcgagcccuacgugagcugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 83319 - RNA, 1410 nt, Artificial Sequence; identical to SEQ ID NO: 75720
  derived and/or modified sequence opt1 from neuraminidase__InfluenzaA__AFJ78015

SEQ ID NO: 83320 - RNA, 1410 nt, Artificial Sequence; identical to SEQ ID NO: 82577
  derived and/or modified sequence opt1 from neuraminidase__InfluenzaA__AFJ78026

SEQ ID NO: 83321 - RNA, 1410 nt, Artificial Sequence; identical to SEQ ID NO: 82577
  derived and/or modified sequence opt1 from neuraminidase__InfluenzaA__AFJ78037

SEQ ID NO: 83322 - RNA, 1410 nt, Artificial Sequence
  derived and/or modified sequence opt1 from neuraminidase__InfluenzaA__AFJ78048
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacgggaacgccuccggcaaggccgacaccaagauccucuucaucgaggagggcaagaucgugcacacgagcacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 83323 - RNA, 1410 nt, Artificial Sequence
  derived and/or modified sequence opt1 from neuraminidase__InfluenzaA__AFJ78059
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaccguccacgaccgcacccccuaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacagcaagcugcagaucaaccgccaggugaucguggaccggggcaaccgguccggguacagcggcaucuucuccgucgagggcaagagcugcaucaaccgcugcuucuacguggagcucauccgggggcgcaaggacgagaccgaggugcuguggaccagcaacuccaucgucguguucugcggcaccagcgggacguacggcaccggguccuggcccgacggcgccgacaucaaccugaugcccaucuga

SEQ ID NO: 83324 - RNA, 1410 nt, Artificial Sequence
  derived and/or modified sequence opt1 from neuraminidase__InfluenzaA__AFJ78070
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucuccgagaagucccggagcggguacgagaccuucaaggucaucgagggcuggagcaaccccaacuccaagcugcagaucaaccgccaggugaucguggaccgggggaaccgcagcggcuacuccgggaucuucagcgucgagggcaagagcugcaucaaccggugcuucuacguggagcugauccgcggccggaaggaggagaccgaggugcucuggaccuccaacagcaucgucguguucugcgggaccuccggcacguacgggaccggcagcuggccggacggggccgacaucaaccugaugcccaucuga

SEQ ID NO: 83325 - RNA, 1410 nt, Artificial Sequence
  derived and/or modified sequence opt1 from neuraminidase__InfluenzaA__AFJ78081
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacaacuccagcuccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaacagcaagcugcagaugaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcaccagcgggacguacggcaccggguccuggccggacggcgccgacaucaaccugaugcccaucuga

SEQ ID NO: 83326 - RNA, 1410 nt, Artificial Sequence; identical to SEQ ID NO: 83242
  derived and/or modified sequence opt1 from neuraminidase__InfluenzaA__AFJ78092

SEQ ID NO: 83327 - RNA, 1410 nt, Artificial Sequence
  derived and/or modified sequence opt1 from neuraminidase__InfluenzaA__AFJ78103
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccugcugggguccgcgcagcacguggaggagugcagcugcuacccccgguaccccggcgugcgcugcgucugccgggacaacuggaagggguccaaccgcccgaucguggacaucaacaucaaggaccacagcaucguguccagcuacgucugcuccggccucgugggcgacacgccccggaagaacgacagcuccagcuccgggcacugccuggaccccaacaacgaggagggcgggcacggcgugaaggggugggccuucgacgacggcaacgacgucuggaugggccgcaccaucagcgagaagucccggcugggguacgagaccuucaaggugaucgagggcuggagcaaccccuccagcaagcuccagaucaaccgccaggucaucguggaccgggggaaccgcuccggcuacagcgggaucuucuccguggagggcaagagcugcaucaaccggugcuucuacgucgagcugauccgcggccggaaggaggagaccgaggugcuguggaccagcaacuccaucguggucuucugcgggaccagcggcacguacgggaccggcuccuggccggacggggccgacaucaaccucaugcccaucuga

SEQ ID NO: 83328 - RNA, 1410 nt, Artificial Sequence
  derived and/or modified sequence opt1 from neuraminidase__InfluenzaA__AFJ78114
augaaccccaaccagaagaucaucaccaucggcagcgugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccaucgugagcugguccaaggagauccuccgcacccaggagagcgagugcgucugcaucaacggcacgugcaccguggugaugaccgacggguccgccagcggcaaggccgacaccaagauccuguucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcuccagaucaaccgccaggucaucguggaccggagcaaccgcuccggcuacagcgggaucuucagcguggagggcaaguccugcaucaaccggugcuucuacgucgagcugauccgcgggcggaaggaggagaccgaggugcuguggaccagcaacuccaucguggucuucugcggcaccagcggcacguacgggaccggcuccuggccggacggggccgacaucaaccucaugcccaucuga

SEQ ID NO: 83329 - RNA, 1410 nt, Artificial Sequence
  derived and/or modified sequence opt1 from neuraminidase__InfluenzaA__AFJ78125
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaugaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 83330 - RNA, 1410 nt, Artificial Sequence
  derived and/or modified sequence opt1 from neuraminidase__InfluenzaA__AFJ78136
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 83331 - RNA, 1410 nt, Artificial Sequence; identical to SEQ ID NO: 83330
  derived and/or modified sequence opt1 from neuraminidase__InfluenzaA__AFJ78147

SEQ ID NO: 83332 - RNA, 1410 nt, Artificial Sequence; identical to SEQ ID NO: 83330
  derived and/or modified sequence opt1 from neuraminidase__InfluenzaA__AFJ78158

SEQ ID NO: 83333 - RNA, 1410 nt, Artificial Sequence; identical to SEQ ID NO: 76892
  derived and/or modified sequence opt1 from neuraminidase__InfluenzaA__AFJ78169

SEQ ID NO: 83334 - RNA, 1410 nt, Artificial Sequence; identical to SEQ ID NO: 77410
  derived and/or modified sequence opt1 from neuraminidase__InfluenzaA__AFJ78180

SEQ ID NO: 83335 - RNA, 1410 nt, Artificial Sequence; identical to SEQ ID NO: 76892
  derived and/or modified sequence opt1 from neuraminidase__InfluenzaA__AFJ78191

SEQ ID NO: 83336 - RNA, 1410 nt, Artificial Sequence
  derived and/or modified sequence opt1 from neuraminidase__InfluenzaA__AFJ78202
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaucaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggggcgcgcagcacguggaggagugcagcugcuacccccgguaccccggggugcgcugcgucugccgggacaacuggaagggcuccaaccgcccgaucguggacaucaacaucaaggaccacagcaucguguccagcuacgucugcuccggccuggugggggacacgccccggaagaacgacagcuccagcuccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgacaucagccugaugcccaucuga

SEQ ID NO: 83337 - RNA, 1410 nt, Artificial Sequence
  derived and/or modified sequence opt1 from neuraminidase__InfluenzaA__AFJ78213
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcucaucuga

SEQ ID NO: 83338 - RNA, 1410 nt, Artificial Sequence; identical to SEQ ID NO: 76892
  derived and/or modified sequence opt1 from neuraminidase__InfluenzaA__AFJ78224

SEQ ID NO: 83339 - RNA, 1410 nt, Artificial Sequence; identical to SEQ ID NO: 76892
  derived and/or modified sequence opt1 from neuraminidase__InfluenzaA__AFJ78235

SEQ ID NO: 83340 - RNA, 1410 nt, Artificial Sequence
  derived and/or modified sequence opt1 from neuraminidase__InfluenzaA__AFJ78246
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggccaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacgacaccgugcgcgaccggaccccguaccgcacccugcucaugaacgagcugggcguccccuuccaccugggcacgaagcaggucugcaucgccuggagcuccagcuccugccacgacgggaaggcguggcuccacgugugcaucaccggcgacgacaagaacgccaccgccagcuucaucuacaacgggcggcugguggacuccaucgugagcugguccaaggagauccugcgcacccaggagagcgagugcgugugcaucaacggcacgugcaccgucgugaugaccgacggguccgccagcggcaaggcggacaccaagauccucuucaucgaggagggcaagaucgugcacacgagcacccuguccgggagcgcccagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 83341 - RNA, 1410 nt, Artificial Sequence
  derived and/or modified sequence opt1 from neuraminidase__InfluenzaA__AFJ78268
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcaagcuguccgggagcgcgcagcacguggaggagugcuccugcuacccccgguaccccggcgugcgcugcgucugccgggacaacuggaaggggagcaaccgcccgaucguggacaucaacaugaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 83342 - RNA, 1410 nt, Artificial Sequence
  derived and/or modified sequence opt1 from neuraminidase__InfluenzaA__AFJ78279
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaucaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggggcgcgcagcacguggaggagugcagcugcuacccccgguaccccggggugcgcugcgucugccgggacaacuggaagggcuccaaccgcccgaucguggacaucaacaucaaggaccacagcaucguguccagcuacgucugcuccggccuggugggggacacgccccggaagaacgacagcuccagcuccagccacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgacaucaaccugaugcccaucuga

SEQ ID NO: 83343 - RNA, 1410 nt, Artificial Sequence
  derived and/or modified sequence opt1 from neuraminidase__InfluenzaA__AFJ78290
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcgcgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 83344 - RNA, 1413 nt, Artificial Sequence
  derived and/or modified sequence opt1 from neuraminidase__InfluenzaA__AFJ78312
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcgcccgcgggagaacaccaccaucuggacguccggcagcuccaucagcuucugcggggucaacuccgacaccgccaacuggagcuggcccgacggcgccgagcuccccuucaccaucgacaaguga

SEQ ID NO: 83345 - RNA, 1410 nt, Artificial Sequence; identical to SEQ ID NO: 83277
  derived and/or modified sequence opt1 from neuraminidase__InfluenzaA__AFJ78323

SEQ ID NO: 83346 - RNA, 1413 nt, Artificial Sequence
  derived and/or modified sequence opt1 from neuraminidase__InfluenzaA__AFJ78334
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 83347 - RNA, 1413 nt, Artificial Sequence; identical to SEQ ID NO: 83346
  derived and/or modified sequence opt1 from neuraminidase__InfluenzaA__AFJ78345

SEQ ID NO: 83348 - RNA, 1413 nt, Artificial Sequence
  derived and/or modified sequence opt1 from neuraminidase__InfluenzaA__AFJ78356
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggucgggaaggacaagaccagcgugacccuggcgggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccagcccguacaacagcaaguucgaguccguggcguggagcgccuccgccugccacgacggcaugggcuggcucaccaucgggaucagcggccccgacaacggggccgucgcggugcugaaguacaacggcaucaucacggagaccaucaaguccuggaagaagcagauccugcgcacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcaucugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgccgacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggcgaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 83349 - RNA, 1413 nt, Artificial Sequence
  derived and/or modified sequence opt1 from neuraminidase__InfluenzaA__AFJ78367
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcgcccgcgggagaacaccaccaucuggacguccggcagcuccaucagcuucugcggggucaacggcgacaccgccaacugguccuggcccgacggcgccgagcuccccuucaccaucgacaaguga

SEQ ID NO: 83350 - RNA, 1413 nt, Artificial Sequence
  derived and/or modified sequence opt1 from neuraminidase__InfluenzaA__AFJ78378
augaaccccaaccagaaggugaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccacauggagugccggacguucuuccucacccagggggcccugcugaacgacaagcacuccaacggcaccgugaaggaccgcagccccuaccgggcccucauguccugcccccugggggaggcgcccagcccguacaacagcaaguucgaguccguggccuggagcgccuccgccugccacgacggcaugggcuggcugaccaucgggaucagcggccccgacaacggggcggucgccgugcucaaguacaacggcaucaucacggagaccaucaaguccuggaagaagcgcauccugcggacccaggagagcgagugcgugugcgucaacggcuccugcuucaccaucaugacggacgggcccagcaacggcgccgccuccuacaagaucuucaagaucgagaaggggaaggugaccaagagcaucgagcugaacgcccccaacucccacuacgaggagugcagcugcuacccggacaccggcaccgugaugugcgucugccgcgacaacuggcacggguccaaccggcccugggugagcuucaaccagaaccucgacuaccagaucggcuacaucugcuccggcguguucggggacaacccccgcccccgggacggcgaggggagcugcaacccggucacgguggacggcgcggacggggugaagggcuucuccuacaaguacggcaacggggucuggaucggccgcaccaagagcaaccggcugcgcaagggguucgagaugaucugggaccccaacggcuggaccgacaccgacuccgacuucgccgugaagcaggacguggucgccaucacggacuggagcggguacagcggcuccuucgugcagcaccccgagcugaccggccucgacugcauccggcccugcuucugggucgagcuggugcgcgggcugccgcgggagaacaccaccaucuggacgagcggcuccagcaucuccuucugcggggugaacagcgacaccgccaacugguccuggcccgacggcgccgagcuccccuucaccaucgacaaguga

SEQ ID NO: 83351 - RNA, 1413 nt, Artificial Sequence; identical to SEQ ID NO: 75394
  derived and/or modified sequence opt1 from neuraminidase__InfluenzaA__AFJ78389

SEQ ID NO: 83352 - RNA, 1413 nt, Artificial Sequence; identical to SEQ ID NO: 75394
  derived and/or modified sequence opt1 from neuraminidase__InfluenzaA__AFJ78400

SEQ ID NO: 83353 - RNA, 1413 nt, Artificial Sequence; identical to SEQ ID NO: 75394
  derived and/or modified sequence opt1 from neuraminidase__InfluenzaA__AFJ78411

SEQ ID NO: 83354 - RNA, 1413 nt, Artificial Sequence
  derived and/or modified sequence opt1 from neuraminidase__InfluenzaA__AFJ78422
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaccggcuggcucacgaucgggaucagcggccccgacaacggggcgguggccguccugaaguacaacggcaucaucaccgagaccaucaaguccuggaagaagcgcauccugcggacccaggagagcgagugcgugugcaugaacggcuccugcuucacgaucaugaccgacgggcccagcaacggcgccgccuccuacaagaucuucaagaucgagaaggggaaggugaccaagagcaucgagcucaacgcccccuccuuccacuacgaggagugcagcugcuacccggacaccggcacggucaugugcgugugccgcgacaacuggcacggguccaaccggcccugggugagcuucaaccagaaccuggacuaccagaucggcuacaucugcuccggcgucuucggggacaacccccgcccccaggacggcgaggggagcugcaacccggugaccguggacggcgcggacggggucaagggcuucuccuacaaguacggcaacgggguguggaucggccggaccaagagcaaccgccugcggaagggguucgagaugaucugggaccccaacggcuggaccaacacggacuccgacuucagcgugaagcaggacgucguggccaucaccgacuggagcggguacuccggcagcuucgugcagcaccccgagcucaccggccuggacugcauccgccccugcuucugggucgagcuggugcgggggcucccgcgcgagaacaccacgaucuggaccuccggcagcuccaucagcuucugcggggucaacuccgacaccgccaacuggagcuggcccgacggcgccgagcugcccuucaccaucgacaaguga

SEQ ID NO: 83355 - RNA, 1413 nt, Artificial Sequence; identical to SEQ ID NO: 77501
  derived and/or modified sequence opt1 from neuraminidase__InfluenzaA__AFJ78433

SEQ ID NO: 83356 - RNA, 1413 nt, Artificial Sequence; identical to SEQ ID NO: 77501
  derived and/or modified sequence opt1 from neuraminidase__InfluenzaA__AFJ78444

SEQ ID NO: 83357 - RNA, 1413 nt, Artificial Sequence
  derived and/or modified sequence opt1 from neuraminidase__InfluenzaA__AFJ78466
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaucggcuggcucaccaucgggaucagcggccccgacaacggggcgguggccguccugaaguacaacggcaucaucacgggcaccaucaaguccuggaagaagcagauccugcgcacccaggagagcgagugcgugugcaucaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgggacaacuggcacggcagcaaccgccccuggguguccuucaaccagaaccuggacuaccagaucggcuacaucugcagcggggucuucggcgacaacccccggcccaaggacggggagggccgcugcaacccggugacgguggacggggcggacggcgucaagggcuucuccuacaaguacgggaacggcguguggaucgggcggaccaagagcaaccgccugcggaagggcuucgagaugaucugggaccccaacggguggaccaacaccgacuccgacuucagcgugaagcaggacgucguggccaucacggacugguccggcuacagcggcagcuucgugcagcaccccgagcucaccgggcuggacugcauccgccccugcuucugggucgagcuggugcggggccucccgcgcgagaacaccaccaucuggacguccgggagcuccaucagcuucugcggcgucaacuccgacaccgccaacuggagcuggcccgacggcgccgagcugcccuucaccaucgacaaguga

SEQ ID NO: 83358 - RNA, 1413 nt, Artificial Sequence
  derived and/or modified sequence opt1 from neuraminidase__InfluenzaA__AFJ78477
augaaccccaaccagaagaucaucaccaucggcagcaucuccaucgccaucgggaucaucggccugaugcuccagaucgggaacaucaucagcaucugggccucccacagcauccagaccggcucccagaaccacacggggaucugcagccagcgcaucaucaccuacgagaacuccaccugggugaacaacaccuacgucaacaucaacaacacgaacgugguggcggagaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagccgcuucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagagcgagugcgugugcaugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcggcaccgccaacugguccuggcccgacggcgccgagcugcccuucaccaucgacaaguga

SEQ ID NO: 83359 - RNA, 1413 nt, Artificial Sequence
  derived and/or modified sequence opt1 from neuraminidase__InfluenzaA__AFJ78488
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagccgcuucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugagcuucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagagcaaccggcugcgcaagggcuucgagaugaucugggaccccaacggguggaccaacacggacuccgacuucagcaugaagcaggacguggucgccaucaccgacugguccggcuacagcgggagcuucgugcagcaccccgagcucaccggccuggacugcauccggcccugcuucuggguggagcugguccgcggccucccgcgggagaacaccacgaucuggaccuccgggagcuccaucagcuucugcggcgugaacuccgggaccgccaacuggagcuggcccgacggcgccgagcugcccuucaccaucgacaaguga

SEQ ID NO: 83360 - RNA, 1413 nt, Artificial Sequence
  derived and/or modified sequence opt1 from neuraminidase__InfluenzaA__AFJ78510
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggcuacaucugcagcggggucuucggcgacaacccccggcccaaggacggggagggcuccugcaacccggugaccguggacggggcggacggcgucaagggcuucagcuacaaguacgacaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 83361 - RNA, 1413 nt, Artificial Sequence
  derived and/or modified sequence opt1 from neuraminidase__InfluenzaA__AFJ78521
augaaccccaaccagaagaucaucaccaucggcagcaucuccaucgccaucgggaucaucagccugauccuccagaucggcaacaucaucuccaucugggccagccacuccauccagaccgggagccagaaccacacgggcaucugcaaccagcgcaucaucaccuacgagaacuccaccugggugaacaacaccuacgucaacaucaacaacacgaacgugguggcggagaaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagccgcuucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcagcugcuacccggacaccgggacggucaugugcgugugccgggacaacuggcacggcuccaaccgccccugggugagcuucaaccagaaccuggacuaccagaucggguacaucugcuccggcgucuucggcgacaacccccggcccaaggacggggagggcagcugcaacccggugaccguggacggggcggacggcgucaagggguucuccuacaaguacggcaacggcguguggaucgggcgcaccaagagcaaccggcugcgcaagggcuucgagaugaucugggaccccaacggguggaccaacacggacuccgacuucagcgugaagcaggacgucguggccaucaccgacugguccggcuacagcgggagcuucgugcagcaccccgagcucaccggccuggacugcauccggcccugcuucugggucgagcuggugcgcggccucccgcgggagaacaccacgaucuggaccuccgggagcuccaucagcuucugcggcgucaacuccgggaccgccaacuggagcuggcccgacggcgccgagcugcccuucaccaucgacaaguga

SEQ ID NO: 83362 - RNA, 1413 nt, Artificial Sequence; identical to SEQ ID NO: 83255
  derived and/or modified sequence opt1 from neuraminidase__InfluenzaA__AFJ78532

SEQ ID NO: 83363 - RNA, 1413 nt, Artificial Sequence; identical to SEQ ID NO: 83255
  derived and/or modified sequence opt1 from neuraminidase__InfluenzaA__AFJ78543

SEQ ID NO: 83364 - RNA, 1413 nt, Artificial Sequence; identical to SEQ ID NO: 83255
  derived and/or modified sequence opt1 from neuraminidase__InfluenzaA__AFJ78554

SEQ ID NO: 83365 - RNA, 1413 nt, Artificial Sequence; identical to SEQ ID NO: 83243
  derived and/or modified sequence opt1 from neuraminidase__InfluenzaA__AFJ78565

SEQ ID NO: 83366 - RNA, 1413 nt, Artificial Sequence
  derived and/or modified sequence opt1 from neuraminidase__InfluenzaA__AFJ78576
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccauccacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaccaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcacgggggucuucggcgacaacccccgcccggaggacggggagggcuccugcaaccccgugaccguggacggggcgaacggcgucaagggcuucagcuacaaguacgggaacggcguguggaucgggcggaccaaguccaaccgcauccggaagggcuucgagaugaucugggaccccaacggguggaccaacacggacagcgacuucuccgugaagcaggacaucgucgccaucaccgacuggagcggcuacuccggcagcuucgugcagcaccccgagcugaccgggcucgacugcauccgcccgugcuucuggguggagcugguccggggccugccccgcgagaacaccacgaucuggaccagcggguccagcaucuccuucugcggcgugaacagcgacaucgccaacugguccuggcccgacggcgccgagcuccccuucaccaucgacaaguga

SEQ ID NO: 83367 - RNA, 1413 nt, Artificial Sequence
  derived and/or modified sequence opt1 from neuraminidase__InfluenzaA__AFJ78598
augaaccccaaccagaagaucaucaccaucggcagcaucuccaucgccaucgggaucaucagccugaugcuccagaucggcaacaucaucuccaucugggccagccacuccauccagaccgggauccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccuccccguacaacagcaaguucgagagcguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggagcuccaucagcuucugcggcgucaacuccgacacggccaacuggagcuggcccgacggggccgagcugcccuucaccaucgacaaguga

SEQ ID NO: 83368 - RNA, 1413 nt, Artificial Sequence
  derived and/or modified sequence opt1 from neuraminidase__InfluenzaA__AFJ78609
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucauccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 83369 - RNA, 1413 nt, Artificial Sequence; identical to SEQ ID NO: 78469
  derived and/or modified sequence opt1 from neuraminidase__InfluenzaA__AFJ78620

SEQ ID NO: 83370 - RNA, 1413 nt, Artificial Sequence; identical to SEQ ID NO: 83243
  derived and/or modified sequence opt1 from neuraminidase__InfluenzaA__AFJ78631

SEQ ID NO: 83371 - RNA, 1413 nt, Artificial Sequence; identical to SEQ ID NO: 78469
  derived and/or modified sequence opt1 from neuraminidase__InfluenzaA__AFJ78642

SEQ ID NO: 83372 - RNA, 1413 nt, Artificial Sequence; identical to SEQ ID NO: 78469
  derived and/or modified sequence opt1 from neuraminidase__InfluenzaA__AFJ78653

SEQ ID NO: 83373 - RNA, 1410 nt, Artificial Sequence; identical to SEQ ID NO: 77746
  derived and/or modified sequence opt1 from neuraminidase__InfluenzaA__AFJ78664

SEQ ID NO: 83374 - RNA, 1410 nt, Artificial Sequence; identical to SEQ ID NO: 77746
  derived and/or modified sequence opt1 from neuraminidase__InfluenzaA__AFJ78674

SEQ ID NO: 83375 - RNA, 1410 nt, Artificial Sequence; identical to SEQ ID NO: 77746
  derived and/or modified sequence opt1 from neuraminidase__InfluenzaA__AFJ78684

SEQ ID NO: 83376 - RNA, 1410 nt, Artificial Sequence; identical to SEQ ID NO: 77746
  derived and/or modified sequence opt1 from neuraminidase__InfluenzaA__AFJ78694

SEQ ID NO: 83377 - RNA, 1410 nt, Artificial Sequence; identical to SEQ ID NO: 77746
  derived and/or modified sequence opt1 from neuraminidase__InfluenzaA__AFJ78704

SEQ ID NO: 83378 - RNA, 1410 nt, Artificial Sequence; identical to SEQ ID NO: 77746
  derived and/or modified sequence opt1 from neuraminidase__InfluenzaA__AFJ78714

SEQ ID NO: 83379 - RNA, 1410 nt, Artificial Sequence
  derived and/or modified sequence opt1 from neuraminidase__InfluenzaA__AFJ78724
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83380 - RNA, 1410 nt, Artificial Sequence; identical to SEQ ID NO: 77746
  derived and/or modified sequence opt1 from neuraminidase__InfluenzaA__AFJ78734

SEQ ID NO: 83381 - RNA, 1410 nt, Artificial Sequence; identical to SEQ ID NO: 77746
  derived and/or modified sequence opt1 from neuraminidase__InfluenzaA__AFJ78744

SEQ ID NO: 83382 - RNA, 1410 nt, Artificial Sequence; identical to SEQ ID NO: 77746
  derived and/or modified sequence opt1 from neuraminidase__InfluenzaA__AFJ78754

SEQ ID NO: 83383 - RNA, 1410 nt, Artificial Sequence; identical to SEQ ID NO: 77746
  derived and/or modified sequence opt1 from neuraminidase__InfluenzaA__AFJ78764

SEQ ID NO: 83384 - RNA, 1410 nt, Artificial Sequence; identical to SEQ ID NO: 77746
  derived and/or modified sequence opt1 from neuraminidase__InfluenzaA__AFJ78774

SEQ ID NO: 83385 - RNA, 1410 nt, Artificial Sequence; identical to SEQ ID NO: 77746
  derived and/or modified sequence opt1 from neuraminidase__InfluenzaA__AFJ78784

SEQ ID NO: 83386 - RNA, 1410 nt, Artificial Sequence
  derived and/or modified sequence opt1 from neuraminidase__InfluenzaA__AFJ78794
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccggcgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 83387 - RNA, 1410 nt, Artificial Sequence; identical to SEQ ID NO: 77746
  derived and/or modified sequence opt1 from neuraminidase__InfluenzaA__AFJ78804

SEQ ID NO: 83388 - RNA, 1410 nt, Artificial Sequence; identical to SEQ ID NO: 77746
  derived and/or modified sequence opt1 from neuraminidase__InfluenzaA__AFJ78814

SEQ ID NO: 83389 - RNA, 1410 nt, Artificial Sequence; identical to SEQ ID NO: 77746
  derived and/or modified sequence opt1 from neuraminidase__InfluenzaA__AFJ78824

SEQ ID NO: 83390 - RNA, 1410 nt, Artificial Sequence; identical to SEQ ID NO: 77746
  derived and/or modified sequence opt1 from neuraminidase__InfluenzaA__AFJ78834

SEQ ID NO: 83391 - RNA, 1410 nt, Artificial Sequence; identical to SEQ ID NO: 77746
  derived and/or modified sequence opt1 from neuraminidase__InfluenzaA__AFJ78844

SEQ ID NO: 83392 - RNA, 1410 nt, Artificial Sequence; identical to SEQ ID NO: 79995
  derived and/or modified sequence opt1 from neuraminidase__InfluenzaA__AFJ78854

SEQ ID NO: 83393 - RNA, 1410 nt, Artificial Sequence; identical to SEQ ID NO: 77746
  derived and/or modified sequence opt1 from neuraminidase__InfluenzaA__AFJ78864

SEQ ID NO: 83394 - RNA, 1410 nt, Artificial Sequence; identical to SEQ ID NO: 77746
  derived and/or modified sequence opt1 from neuraminidase__InfluenzaA__AFJ78874

SEQ ID NO: 83395 - RNA, 1410 nt, Artificial Sequence; identical to SEQ ID NO: 77746
  derived and/or modified sequence opt1 from neuraminidase__InfluenzaA__AFJ78884

SEQ ID NO: 83396 - RNA, 1410 nt, Artificial Sequence; identical to SEQ ID NO: 77746
  derived and/or modified sequence opt1 from neuraminidase__InfluenzaA__AFJ78894

SEQ ID NO: 83397 - RNA, 1410 nt, Artificial Sequence; identical to SEQ ID NO: 77746
  derived and/or modified sequence opt1 from neuraminidase__InfluenzaA__AFJ78904

SEQ ID NO: 83398 - RNA, 1410 nt, Artificial Sequence; identical to SEQ ID NO: 77746
  derived and/or modified sequence opt1 from neuraminidase__InfluenzaA__AFJ78914

SEQ ID NO: 83399 - RNA, 1410 nt, Artificial Sequence
  derived and/or modified sequence opt1 from neuraminidase__InfluenzaA__AFJ78924
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacguggacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagauccccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83400 - RNA, 1410 nt, Artificial Sequence
  derived and/or modified sequence opt1 from neuraminidase__InfluenzaA__AFJ97569
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucuccuggagcuggcccgacggcgccgagcugccguucacgaucgacaaguga

SEQ ID NO: 83401 - RNA, 1410 nt, Artificial Sequence; identical to SEQ ID NO: 77736
  derived and/or modified sequence opt1 from neuraminidase__InfluenzaA__AFK14107

SEQ ID NO: 83402 - RNA, 1410 nt, Artificial Sequence; identical to SEQ ID NO: 77746
  derived and/or modified sequence opt1 from neuraminidase__InfluenzaA__AFK14117

SEQ ID NO: 83403 - RNA, 1410 nt, Artificial Sequence; identical to SEQ ID NO: 78513
  derived and/or modified sequence opt1 from neuraminidase__InfluenzaA__AFK14141

SEQ ID NO: 83404 - RNA, 1410 nt, Artificial Sequence
  derived and/or modified sequence opt1 from neuraminidase__InfluenzaA__AFK14150
augaaccccaaccagaagaucaucaccaucggcagcgugugcaugaccaucgggauggccaaccugauccuccagaucggcaacaucaucuccaucuggaucagccacuccauccgccuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacgagcaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 83405 - RNA, 1410 nt, Artificial Sequence; identical to SEQ ID NO: 78329
  derived and/or modified sequence opt1 from neuraminidase__InfluenzaA__AFK14159

SEQ ID NO: 83406 - RNA, 1410 nt, Artificial Sequence; identical to SEQ ID NO: 77746
  derived and/or modified sequence opt1 from neuraminidase__InfluenzaA__AFK14168

SEQ ID NO: 83407 - RNA, 1410 nt, Artificial Sequence; identical to SEQ ID NO: 77746
  derived and/or modified sequence opt1 from neuraminidase__InfluenzaA__AFK14177

SEQ ID NO: 83408 - RNA, 1410 nt, Artificial Sequence
  derived and/or modified sequence opt1 from neuraminidase__InfluenzaA__AFK14186
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuucgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83409 - RNA, 1410 nt, Artificial Sequence; identical to SEQ ID NO: 79727
  derived and/or modified sequence opt1 from neuraminidase__InfluenzaA__AFK14195

SEQ ID NO: 83410 - RNA, 1410 nt, Artificial Sequence; identical to SEQ ID NO: 77746
  derived and/or modified sequence opt1 from neuraminidase__InfluenzaA__AFK14204

SEQ ID NO: 83411 - RNA, 1410 nt, Artificial Sequence; identical to SEQ ID NO: 79727
  derived and/or modified sequence opt1 from neuraminidase__InfluenzaA__AFK14213

SEQ ID NO: 83412 - RNA, 1410 nt, Artificial Sequence
  derived and/or modified sequence opt1 from neuraminidase__InfluenzaA__AFK14222
augaaccccaaccagaagaucaucaccaucggcagcgugugcaugaccaucgggauggccaaccugauccuccagaucggcaacaucaucuccaucuggaucagccacuccauccgccuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 83413 - RNA, 1410 nt, Artificial Sequence; identical to SEQ ID NO: 78329
  derived and/or modified sequence opt1 from neuraminidase__InfluenzaA__AFK14231

SEQ ID NO: 83414 - RNA, 1410 nt, Artificial Sequence; identical to SEQ ID NO: 77746
  derived and/or modified sequence opt1 from neuraminidase__InfluenzaA__AFK14240

SEQ ID NO: 83415 - RNA, 1410 nt, Artificial Sequence; identical to SEQ ID NO: 78513
  derived and/or modified sequence opt1 from neuraminidase__InfluenzaA__AFK14249

SEQ ID NO: 83416 - RNA, 1410 nt, Artificial Sequence; identical to SEQ ID NO: 77746
  derived and/or modified sequence opt1 from neuraminidase__InfluenzaA__AFK14257

SEQ ID NO: 83417 - RNA, 1410 nt, Artificial Sequence; identical to SEQ ID NO: 77746
  derived and/or modified sequence opt1 from neuraminidase__InfluenzaA__AFK14266

SEQ ID NO: 83418 - RNA, 1410 nt, Artificial Sequence; identical to SEQ ID NO: 77746
  derived and/or modified sequence opt1 from neuraminidase__InfluenzaA__AFK14274

SEQ ID NO: 83419 - RNA, 1410 nt, Artificial Sequence
  derived and/or modified sequence opt1 from neuraminidase__InfluenzaA__AFK14281
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccgacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83420 - RNA, 1410 nt, Artificial Sequence; identical to SEQ ID NO: 77746
  derived and/or modified sequence opt1 from neuraminidase__InfluenzaA__AFK14289

SEQ ID NO: 83421 - RNA, 1410 nt, Artificial Sequence; identical to SEQ ID NO: 78329
  derived and/or modified sequence opt1 from neuraminidase__InfluenzaA__AFK14298

SEQ ID NO: 83422 - RNA, 1410 nt, Artificial Sequence; identical to SEQ ID NO: 77746
  derived and/or modified sequence opt1 from neuraminidase__InfluenzaA__AFK14307

SEQ ID NO: 83423 - RNA, 1410 nt, Artificial Sequence; identical to SEQ ID NO: 79727
  derived and/or modified sequence opt1 from neuraminidase__InfluenzaA__AFK14316

SEQ ID NO: 83424 - RNA, 1410 nt, Artificial Sequence
  derived and/or modified sequence opt1 from neuraminidase__InfluenzaA__AFK14325
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagcgggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 83425 - RNA, 1410 nt, Artificial Sequence; identical to SEQ ID NO: 77746
  derived and/or modified sequence opt1 from neuraminidase__InfluenzaA__AFK14334

SEQ ID NO: 83426 - RNA, 1410 nt, Artificial Sequence; identical to SEQ ID NO: 77746
  derived and/or modified sequence opt1 from neuraminidase__InfluenzaA__AFK14343

SEQ ID NO: 83427 - RNA, 1410 nt, Artificial Sequence; identical to SEQ ID NO: 77746
  derived and/or modified sequence opt1 from neuraminidase__InfluenzaA__AFK14352

SEQ ID NO: 83428 - RNA, 1410 nt, Artificial Sequence; identical to SEQ ID NO: 77746
  derived and/or modified sequence opt1 from neuraminidase__InfluenzaA__AFK14360

SEQ ID NO: 83429 - RNA, 1410 nt, Artificial Sequence; identical to SEQ ID NO: 77746
  derived and/or modified sequence opt1 from neuraminidase__InfluenzaA__AFK14369

SEQ ID NO: 83430 - RNA, 1410 nt, Artificial Sequence
  derived and/or modified sequence opt1 from neuraminidase__InfluenzaA__AFK14387
augaaccccaaccagaagaucaucaccaucggcagcgugugcaugaccaucgggauggccaaccugauccuccagaucggcaacaucacguccaucuggaucagccacuccauccagcuggggaaccagaaccagaucgacacgugcaaccagagcgucaucaccuacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 83431 - RNA, 1410 nt, Artificial Sequence; identical to SEQ ID NO: 78329
  derived and/or modified sequence opt1 from neuraminidase__InfluenzaA__AFK14397

SEQ ID NO: 83432 - RNA, 1410 nt, Artificial Sequence; identical to SEQ ID NO: 77746
  derived and/or modified sequence opt1 from neuraminidase__InfluenzaA__AFK14406

SEQ ID NO: 83433 - RNA, 1410 nt, Artificial Sequence; identical to SEQ ID NO: 77746
  derived and/or modified sequence opt1 from neuraminidase__InfluenzaA__AFK14415

SEQ ID NO: 83434 - RNA, 1410 nt, Artificial Sequence; identical to SEQ ID NO: 77746
  derived and/or modified sequence opt1 from neuraminidase__InfluenzaA__AFK14424

SEQ ID NO: 83435 - RNA, 1410 nt, Artificial Sequence
  derived and/or modified sequence opt1 from neuraminidase__InfluenzaA__AFK14433
augaaccccaaccagaagaucaucaccaucggcagcgugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 83436 - RNA, 1410 nt, Artificial Sequence; identical to SEQ ID NO: 77746
  derived and/or modified sequence opt1 from neuraminidase__InfluenzaA__AFK14442

SEQ ID NO: 83437 - RNA, 1410 nt, Artificial Sequence
  derived and/or modified sequence opt1 from neuraminidase__InfluenzaA__AFK14451
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgccaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcgcuccugaacgacaagcacuccaacgggaccaucaaggaccggucccccuaccgcacgcugaugagcugcccgaucggcgaggugcccucccccuacaacagccgguucgagagcguggccugguccgccagcgccugccacgacgggaucaacuggcucaccaucggcaucuccggccccgacaacggggcggucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggcgaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 83438 - RNA, 1410 nt, Artificial Sequence; identical to SEQ ID NO: 77746
  derived and/or modified sequence opt1 from neuraminidase__InfluenzaA__AFK14458

SEQ ID NO: 83439 - RNA, 1410 nt, Artificial Sequence; identical to SEQ ID NO: 77746
  derived and/or modified sequence opt1 from neuraminidase__InfluenzaA__AFK14467

SEQ ID NO: 83440 - RNA, 1410 nt, Artificial Sequence; identical to SEQ ID NO: 77746
  derived and/or modified sequence opt1 from neuraminidase__InfluenzaA__AFK14476

SEQ ID NO: 83441 - RNA, 1410 nt, Artificial Sequence; identical to SEQ ID NO: 80805
  derived and/or modified sequence opt1 from neuraminidase__InfluenzaA__AFK14485

SEQ ID NO: 83442 - RNA, 1410 nt, Artificial Sequence; identical to SEQ ID NO: 77746
  derived and/or modified sequence opt1 from neuraminidase__InfluenzaA__AFK14504

SEQ ID NO: 83443 - RNA, 1410 nt, Artificial Sequence; identical to SEQ ID NO: 77746
  derived and/or modified sequence opt1 from neuraminidase__InfluenzaA__AFK14514

SEQ ID NO: 83444 - RNA, 1410 nt, Artificial Sequence; identical to SEQ ID NO: 77746
  derived and/or modified sequence opt1 from neuraminidase__InfluenzaA__AFK14522

SEQ ID NO: 83445 - RNA, 1410 nt, Artificial Sequence; identical to SEQ ID NO: 77746
  derived and/or modified sequence opt1 from neuraminidase__InfluenzaA__AFK14529

SEQ ID NO: 83446 - RNA, 1410 nt, Artificial Sequence; identical to SEQ ID NO: 77746
  derived and/or modified sequence opt1 from neuraminidase__InfluenzaA__AFK14538

SEQ ID NO: 83447 - RNA, 1410 nt, Artificial Sequence; identical to SEQ ID NO: 80121
  derived and/or modified sequence opt1 from neuraminidase__InfluenzaA__AFK14547

SEQ ID NO: 83448 - RNA, 1410 nt, Artificial Sequence
  derived and/or modified sequence opt1 from neuraminidase__InfluenzaA__AFK14555
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83449 - RNA, 1410 nt, Artificial Sequence; identical to SEQ ID NO: 77746
  derived and/or modified sequence opt1 from neuraminidase__InfluenzaA__AFK14564

SEQ ID NO: 83450 - RNA, 1410 nt, Artificial Sequence; identical to SEQ ID NO: 77746
  derived and/or modified sequence opt1 from neuraminidase__InfluenzaA__AFK14573

SEQ ID NO: 83451 - RNA, 1410 nt, Artificial Sequence
  derived and/or modified sequence opt1 from neuraminidase__InfluenzaA__AFK14579
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaugugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83452 - RNA, 1410 nt, Artificial Sequence; identical to SEQ ID NO: 77746
  derived and/or modified sequence opt1 from neuraminidase__InfluenzaA__AFK14588

SEQ ID NO: 83453 - RNA, 1410 nt, Artificial Sequence; identical to SEQ ID NO: 77746
  derived and/or modified sequence opt1 from neuraminidase__InfluenzaA__AFK14597

SEQ ID NO: 83454 - RNA, 1410 nt, Artificial Sequence; identical to SEQ ID NO: 77746
  derived and/or modified sequence opt1 from neuraminidase__InfluenzaA__AFK14604

SEQ ID NO: 83455 - RNA, 1410 nt, Artificial Sequence; identical to SEQ ID NO: 77746
  derived and/or modified sequence opt1 from neuraminidase__InfluenzaA__AFK14632

SEQ ID NO: 83456 - RNA, 1410 nt, Artificial Sequence; identical to SEQ ID NO: 77736
  derived and/or modified sequence opt1 from neuraminidase__InfluenzaA__AFK14641

SEQ ID NO: 83457 - RNA, 1410 nt, Artificial Sequence; identical to SEQ ID NO: 77746
  derived and/or modified sequence opt1 from neuraminidase__InfluenzaA__AFK14651

SEQ ID NO: 83458 - RNA, 1410 nt, Artificial Sequence; identical to SEQ ID NO: 77746
  derived and/or modified sequence opt1 from neuraminidase__InfluenzaA__AFK14656

SEQ ID NO: 83459 - RNA, 1410 nt, Artificial Sequence; identical to SEQ ID NO: 77746
  derived and/or modified sequence opt1 from neuraminidase__InfluenzaA__AFK14663

SEQ ID NO: 83460 - RNA, 1410 nt, Artificial Sequence; identical to SEQ ID NO: 77746
  derived and/or modified sequence opt1 from neuraminidase__InfluenzaA__AFK14672

SEQ ID NO: 83461 - RNA, 1410 nt, Artificial Sequence; identical to SEQ ID NO: 77746
  derived and/or modified sequence opt1 from neuraminidase__InfluenzaA__AFK14680

SEQ ID NO: 83462 - RNA, 1410 nt, Artificial Sequence; identical to SEQ ID NO: 77746
  derived and/or modified sequence opt1 from neuraminidase__InfluenzaA__AFK14690

SEQ ID NO: 83463 - RNA, 1410 nt, Artificial Sequence; identical to SEQ ID NO: 77746
  derived and/or modified sequence opt1 from neuraminidase__InfluenzaA__AFK14707

SEQ ID NO: 83464 - RNA, 1410 nt, Artificial Sequence; identical to SEQ ID NO: 77746
  derived and/or modified sequence opt1 from neuraminidase__InfluenzaA__AFK14715

SEQ ID NO: 83465 - RNA, 1410 nt, Artificial Sequence; identical to SEQ ID NO: 77746
  derived and/or modified sequence opt1 from neuraminidase__InfluenzaA__AFK14724

SEQ ID NO: 83466 - RNA, 1410 nt, Artificial Sequence; identical to SEQ ID NO: 77746
  derived and/or modified sequence opt1 from neuraminidase__InfluenzaA__AFK14733

SEQ ID NO: 83467 - RNA, 1410 nt, Artificial Sequence; identical to SEQ ID NO: 77746
  derived and/or modified sequence opt1 from neuraminidase__InfluenzaA__AFK14751

SEQ ID NO: 83468 - RNA, 1410 nt, Artificial Sequence; identical to SEQ ID NO: 77746
  derived and/or modified sequence opt1 from neuraminidase__InfluenzaA__AFK14757

SEQ ID NO: 83469 - RNA, 1410 nt, Artificial Sequence; identical to SEQ ID NO: 77746
  derived and/or modified sequence opt1 from neuraminidase__InfluenzaA__AFK14766

SEQ ID NO: 83470 - RNA, 1410 nt, Artificial Sequence; identical to SEQ ID NO: 78329
  derived and/or modified sequence opt1 from neuraminidase__InfluenzaA__AFK14774

SEQ ID NO: 83471 - RNA, 1410 nt, Artificial Sequence; identical to SEQ ID NO: 83448
  derived and/or modified sequence opt1 from neuraminidase__InfluenzaA__AFK14781

SEQ ID NO: 83472 - RNA, 1410 nt, Artificial Sequence; identical to SEQ ID NO: 78329
  derived and/or modified sequence opt1 from neuraminidase__InfluenzaA__AFK14790

SEQ ID NO: 83473 - RNA, 1410 nt, Artificial Sequence
  derived and/or modified sequence opt1 from neuraminidase__InfluenzaA__AFK14800
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgcccccgggagaacaccaucuggaccagcggguccagcaucuccuucugcggcgugaacagcgacaccgucgggugguccuggcccgacggcgccgagcugccguucacgaucgacaaguga

SEQ ID NO: 83474 - RNA, 1410 nt, Artificial Sequence; identical to SEQ ID NO: 79727
  derived and/or modified sequence opt1 from neuraminidase__InfluenzaA__AFK14809

SEQ ID NO: 83475 - RNA, 1410 nt, Artificial Sequence; identical to SEQ ID NO: 79727
  derived and/or modified sequence opt1 from neuraminidase__InfluenzaA__AFK14816

SEQ ID NO: 83476 - RNA, 1410 nt, Artificial Sequence; identical to SEQ ID NO: 77746
  derived and/or modified sequence opt1 from neuraminidase__InfluenzaA__AFK14824

SEQ ID NO: 83477 - RNA, 1410 nt, Artificial Sequence; identical to SEQ ID NO: 77746
  derived and/or modified sequence opt1 from neuraminidase__InfluenzaA__AFK14841

SEQ ID NO: 83478 - RNA, 1410 nt, Artificial Sequence; identical to SEQ ID NO: 78819
  derived and/or modified sequence opt1 from neuraminidase__InfluenzaA__AFK14849

SEQ ID NO: 83479 - RNA, 1410 nt, Artificial Sequence
  derived and/or modified sequence opt1 from neuraminidase__InfluenzaA__AFK14856
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuucaagaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaucgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 83480 - RNA, 1410 nt, Artificial Sequence; identical to SEQ ID NO: 77746
  derived and/or modified sequence opt1 from neuraminidase__InfluenzaA__AFK14870

SEQ ID NO: 83481 - RNA, 1410 nt, Artificial Sequence; identical to SEQ ID NO: 77746
  derived and/or modified sequence opt1 from neuraminidase__InfluenzaA__AFK14879

SEQ ID NO: 83482 - RNA, 1410 nt, Artificial Sequence; identical to SEQ ID NO: 77746
  derived and/or modified sequence opt1 from neuraminidase__InfluenzaA__AFK14885

SEQ ID NO: 83483 - RNA, 1410 nt, Artificial Sequence; identical to SEQ ID NO: 77746
  derived and/or modified sequence opt1 from neuraminidase__InfluenzaA__AFK14894

SEQ ID NO: 83484 - RNA, 1410 nt, Artificial Sequence; identical to SEQ ID NO: 77746
  derived and/or modified sequence opt1 from neuraminidase__InfluenzaA__AFK14903

SEQ ID NO: 83485 - RNA, 1410 nt, Artificial Sequence; identical to SEQ ID NO: 77746
  derived and/or modified sequence opt1 from neuraminidase__InfluenzaA__AFK14912

SEQ ID NO: 83486 - RNA, 1410 nt, Artificial Sequence; identical to SEQ ID NO: 77746
  derived and/or modified sequence opt1 from neuraminidase__InfluenzaA__AFK14921

SEQ ID NO: 83487 - RNA, 1410 nt, Artificial Sequence; identical to SEQ ID NO: 77746
  derived and/or modified sequence opt1 from neuraminidase__InfluenzaA__AFK14931

SEQ ID NO: 83488 - RNA, 1410 nt, Artificial Sequence
  derived and/or modified sequence opt1 from neuraminidase__InfluenzaA__AFK25604
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuacuacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 83489 - RNA, 1410 nt, Artificial Sequence; identical to SEQ ID NO: 83488
  derived and/or modified sequence opt1 from neuraminidase__InfluenzaA__AFK25606

SEQ ID NO: 83490 - RNA, 1410 nt, Artificial Sequence; identical to SEQ ID NO: 79097
  derived and/or modified sequence opt1 from neuraminidase__InfluenzaA__AFK74537

SEQ ID NO: 83491 - RNA, 1410 nt, Artificial Sequence; identical to SEQ ID NO: 77746
  derived and/or modified sequence opt1 from neuraminidase__InfluenzaA__AFK74547

SEQ ID NO: 83492 - RNA, 1410 nt, Artificial Sequence; identical to SEQ ID NO: 80738
  derived and/or modified sequence opt1 from neuraminidase__InfluenzaA__AFK74557

SEQ ID NO: 83493 - RNA, 1410 nt, Artificial Sequence; identical to SEQ ID NO: 77746
  derived and/or modified sequence opt1 from neuraminidase__InfluenzaA__AFK74567

SEQ ID NO: 83494 - RNA, 1410 nt, Artificial Sequence; identical to SEQ ID NO: 77746
  derived and/or modified sequence opt1 from neuraminidase__InfluenzaA__AFK74578

SEQ ID NO: 83495 - RNA, 1410 nt, Artificial Sequence; identical to SEQ ID NO: 82861
  derived and/or modified sequence opt1 from neuraminidase__InfluenzaA__AFK74588

SEQ ID NO: 83496 - RNA, 1410 nt, Artificial Sequence; identical to SEQ ID NO: 77746
  derived and/or modified sequence opt1 from neuraminidase__InfluenzaA__AFK74598

SEQ ID NO: 83497 - RNA, 1410 nt, Artificial Sequence; identical to SEQ ID NO: 77746
  derived and/or modified sequence opt1 from neuraminidase__InfluenzaA__AFK74608

SEQ ID NO: 83498 - RNA, 1410 nt, Artificial Sequence; identical to SEQ ID NO: 77746
  derived and/or modified sequence opt1 from neuraminidase__InfluenzaA__AFK74618

SEQ ID NO: 83499 - RNA, 1410 nt, Artificial Sequence; identical to SEQ ID NO: 77746
  derived and/or modified sequence opt1 from neuraminidase__InfluenzaA__AFK74628

SEQ ID NO: 83500 - RNA, 1410 nt, Artificial Sequence; identical to SEQ ID NO: 77746
  derived and/or modified sequence opt1 from neuraminidase__InfluenzaA__AFK74638

SEQ ID NO: 83501 - RNA, 1410 nt, Artificial Sequence; identical to SEQ ID NO: 77746
  derived and/or modified sequence opt1 from neuraminidase__InfluenzaA__AFK74648

SEQ ID NO: 83502 - RNA, 1410 nt, Artificial Sequence; identical to SEQ ID NO: 82870
  derived and/or modified sequence opt1 from neuraminidase__InfluenzaA__AFK74658

SEQ ID NO: 83503 - RNA, 1410 nt, Artificial Sequence; identical to SEQ ID NO: 82870
  derived and/or modified sequence opt1 from neuraminidase__InfluenzaA__AFK74668

SEQ ID NO: 83504 - RNA, 1410 nt, Artificial Sequence; identical to SEQ ID NO: 77746
  derived and/or modified sequence opt1 from neuraminidase__InfluenzaA__AFK74678

SEQ ID NO: 83505 - RNA, 1410 nt, Artificial Sequence; identical to SEQ ID NO: 77746
  derived and/or modified sequence opt1 from neuraminidase__InfluenzaA__AFK74688

SEQ ID NO: 83506 - RNA, 1410 nt, Artificial Sequence; identical to SEQ ID NO: 77746
  derived and/or modified sequence opt1 from neuraminidase__InfluenzaA__AFK74698

SEQ ID NO: 83507 - RNA, 1410 nt, Artificial Sequence; identical to SEQ ID NO: 82877
  derived and/or modified sequence opt1 from neuraminidase__InfluenzaA__AFK74708

SEQ ID NO: 83508 - RNA, 1410 nt, Artificial Sequence; identical to SEQ ID NO: 80738
  derived and/or modified sequence opt1 from neuraminidase__InfluenzaA__AFK74718

SEQ ID NO: 83509 - RNA, 1410 nt, Artificial Sequence; identical to SEQ ID NO: 77746
  derived and/or modified sequence opt1 from neuraminidase__InfluenzaA__AFK74728

SEQ ID NO: 83510 - RNA, 1410 nt, Artificial Sequence; identical to SEQ ID NO: 77746
  derived and/or modified sequence opt1 from neuraminidase__InfluenzaA__AFK74738

SEQ ID NO: 83511 - RNA, 1410 nt, Artificial Sequence; identical to SEQ ID NO: 77746
  derived and/or modified sequence opt1 from neuraminidase__InfluenzaA__AFK74748

SEQ ID NO: 83512 - RNA, 1410 nt, Artificial Sequence; identical to SEQ ID NO: 77746
  derived and/or modified sequence opt1 from neuraminidase__InfluenzaA__AFK74758

SEQ ID NO: 83513 - RNA, 1410 nt, Artificial Sequence; identical to SEQ ID NO: 77746
  derived and/or modified sequence opt1 from neuraminidase__InfluenzaA__AFK74768

SEQ ID NO: 83514 - RNA, 1410 nt, Artificial Sequence; identical to SEQ ID NO: 77746
  derived and/or modified sequence opt1 from neuraminidase__InfluenzaA__AFK74778

SEQ ID NO: 83515 - RNA, 1410 nt, Artificial Sequence; identical to SEQ ID NO: 80738
  derived and/or modified sequence opt1 from neuraminidase__InfluenzaA__AFK74788

SEQ ID NO: 83516 - RNA, 1410 nt, Artificial Sequence; identical to SEQ ID NO: 80738
  derived and/or modified sequence opt1 from neuraminidase__InfluenzaA__AFK74798

SEQ ID NO: 83517 - RNA, 1410 nt, Artificial Sequence; identical to SEQ ID NO: 80738
  derived and/or modified sequence opt1 from neuraminidase__InfluenzaA__AFK74808

SEQ ID NO: 83518 - RNA, 1410 nt, Artificial Sequence; identical to SEQ ID NO: 80738
  derived and/or modified sequence opt1 from neuraminidase__InfluenzaA__AFK74818

SEQ ID NO: 83519 - RNA, 1410 nt, Artificial Sequence; identical to SEQ ID NO: 77746
  derived and/or modified sequence opt1 from neuraminidase__InfluenzaA__AFK74828

SEQ ID NO: 83520 - RNA, 1410 nt, Artificial Sequence; identical to SEQ ID NO: 79637
  derived and/or modified sequence opt1 from neuraminidase__InfluenzaA__AFK74838

SEQ ID NO: 83521 - RNA, 1410 nt, Artificial Sequence; identical to SEQ ID NO: 77746
  derived and/or modified sequence opt1 from neuraminidase__InfluenzaA__AFK74848

SEQ ID NO: 83522 - RNA, 1410 nt, Artificial Sequence; identical to SEQ ID NO: 77746
  derived and/or modified sequence opt1 from neuraminidase__InfluenzaA__AFK74898

SEQ ID NO: 83523 - RNA, 1410 nt, Artificial Sequence; identical to SEQ ID NO: 77746
  derived and/or modified sequence opt1 from neuraminidase__InfluenzaA__AFK74908

SEQ ID NO: 83524 - RNA, 1410 nt, Artificial Sequence; identical to SEQ ID NO: 77746
  derived and/or modified sequence opt1 from neuraminidase__InfluenzaA__AFK74918

SEQ ID NO: 83525 - RNA, 1410 nt, Artificial Sequence; identical to SEQ ID NO: 77746
  derived and/or modified sequence opt1 from neuraminidase__InfluenzaA__AFK74928

SEQ ID NO: 83526 - RNA, 1410 nt, Artificial Sequence
  derived and/or modified sequence opt1 from neuraminidase__InfluenzaA__AFK74938
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaacaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83527 - RNA, 1410 nt, Artificial Sequence; identical to SEQ ID NO: 77746
  derived and/or modified sequence opt1 from neuraminidase__InfluenzaA__AFK74948

SEQ ID NO: 83528 - RNA, 1410 nt, Artificial Sequence; identical to SEQ ID NO: 79637
  derived and/or modified sequence opt1 from neuraminidase__InfluenzaA__AFK74958

SEQ ID NO: 83529 - RNA, 1410 nt, Artificial Sequence; identical to SEQ ID NO: 80738
  derived and/or modified sequence opt1 from neuraminidase__InfluenzaA__AFK74968

SEQ ID NO: 83530 - RNA, 1410 nt, Artificial Sequence; identical to SEQ ID NO: 77746
  derived and/or modified sequence opt1 from neuraminidase__InfluenzaA__AFK74978

SEQ ID NO: 83531 - RNA, 1410 nt, Artificial Sequence; identical to SEQ ID NO: 79637
  derived and/or modified sequence opt1 from neuraminidase__InfluenzaA__AFK74988

SEQ ID NO: 83532 - RNA, 1410 nt, Artificial Sequence; identical to SEQ ID NO: 77746
  derived and/or modified sequence opt1 from neuraminidase__InfluenzaA__AFK74998

SEQ ID NO: 83533 - RNA, 1410 nt, Artificial Sequence; identical to SEQ ID NO: 80738
  derived and/or modified sequence opt1 from neuraminidase__InfluenzaA__AFK75008

SEQ ID NO: 83534 - RNA, 1410 nt, Artificial Sequence; identical to SEQ ID NO: 77746
  derived and/or modified sequence opt1 from neuraminidase__InfluenzaA__AFK75018

SEQ ID NO: 83535 - RNA, 1410 nt, Artificial Sequence; identical to SEQ ID NO: 77746
  derived and/or modified sequence opt1 from neuraminidase__InfluenzaA__AFK75028

SEQ ID NO: 83536 - RNA, 1410 nt, Artificial Sequence; identical to SEQ ID NO: 77746
  derived and/or modified sequence opt1 from neuraminidase__InfluenzaA__AFK75038

SEQ ID NO: 83537 - RNA, 1410 nt, Artificial Sequence; identical to SEQ ID NO: 77746
  derived and/or modified sequence opt1 from neuraminidase__InfluenzaA__AFK75048

SEQ ID NO: 83538 - RNA, 1410 nt, Artificial Sequence; identical to SEQ ID NO: 77746
  derived and/or modified sequence opt1 from neuraminidase__InfluenzaA__AFK75058

SEQ ID NO: 83539 - RNA, 1410 nt, Artificial Sequence; identical to SEQ ID NO: 80738
  derived and/or modified sequence opt1 from neuraminidase__InfluenzaA__AFK75068

SEQ ID NO: 83540 - RNA, 1410 nt, Artificial Sequence; identical to SEQ ID NO: 77746
  derived and/or modified sequence opt1 from neuraminidase__InfluenzaA__AFK75078

SEQ ID NO: 83541 - RNA, 1410 nt, Artificial Sequence; identical to SEQ ID NO: 77746
  derived and/or modified sequence opt1 from neuraminidase__InfluenzaA__AFK75088

SEQ ID NO: 83542 - RNA, 1410 nt, Artificial Sequence; identical to SEQ ID NO: 77746
  derived and/or modified sequence opt1 from neuraminidase__InfluenzaA__AFK75098

SEQ ID NO: 83543 - RNA, 1410 nt, Artificial Sequence; identical to SEQ ID NO: 79659
  derived and/or modified sequence opt1 from neuraminidase__InfluenzaA__AFK75108

SEQ ID NO: 83544 - RNA, 1410 nt, Artificial Sequence; identical to SEQ ID NO: 77746
  derived and/or modified sequence opt1 from neuraminidase__InfluenzaA__AFK77860

SEQ ID NO: 83545 - RNA, 1410 nt, Artificial Sequence; identical to SEQ ID NO: 77746
  derived and/or modified sequence opt1 from neuraminidase__InfluenzaA__AFK77870

SEQ ID NO: 83546 - RNA, 1410 nt, Artificial Sequence; identical to SEQ ID NO: 77746
  derived and/or modified sequence opt1 from neuraminidase__InfluenzaA__AFK77880

SEQ ID NO: 83547 - RNA, 1410 nt, Artificial Sequence
  derived and/or modified sequence opt1 from neuraminidase__InfluenzaA__AFK77890
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagggcaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 83548 - RNA, 1410 nt, Artificial Sequence
  derived and/or modified sequence opt1 from neuraminidase__InfluenzaA__AFK77900
augaaccccaaccagaagaucaucaccaucggcagcgugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccugugcccggugagcggcugggccaucuacuccaaggacaacagcauccgcaucggcuccaagggggacgucuucgugauccgggagcccuucaucagcugcagcccccucgagugccgcaccuucuuccugacccagggcgcccugcucaacgacaagcacuccaacgggaccaucaaggaccggucccccuaccgcgcgcugaugagcugcccgaucggcgaggugcccucccccuacaacagccgguucgagagcgucgccugguccgccagcgccugccacgacgggaucaacuggcugacgaucggcaucuccggccccgacaacggggcgguggccgugcucaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggcgaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaugaacgagugguccggcuacagcggguccuucguccagcacccggagcucaccggccuggacugcauccgccccugcuucuggguggagcugauccggggccgccccaaggagaacacgaucuggaccagcggguccagcaucuccuucugcggcgugaacagcgacaccgucgggugguccuggcccgacggcgccgagcucccguucaccaucgacaaguga

SEQ ID NO: 83549 - RNA, 1410 nt, Artificial Sequence
  derived and/or modified sequence opt1 from neuraminidase__InfluenzaA__AFK78031
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcgcgcugaugagcugcccgaucggcgaggugcccucccccuacaacagccgguucgagagcgucgccugguccgccagcgccugccacgacgggaucaacuggcucacgaucggcaucuccggccccgacaacggggcgguggccgugcugaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggcgaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaugaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 83550 - RNA, 1410 nt, Artificial Sequence; identical to SEQ ID NO: 77746
  derived and/or modified sequence opt1 from neuraminidase__InfluenzaA__AFK78190

SEQ ID NO: 83551 - RNA, 1362 nt, Artificial Sequence
  derived and/or modified sequence opt1 from neuraminidase__InfluenzaA__AFM68957
augaaccccaaccagaagaucaucaccaucggcagcaucugcaugguggucgggaucaucucccugauccuccagaucggcaacaucaucagcaucuggaucucccacagcauccagaccgggaaccagaaccacacgggcaucugcaaccaggggaucaucacccacaacgugguggccggccaggacuccaccagcgucauccugaccggcaacuccagccugugcccgauccgcgggugggccauccacuccaaggacaacggcauccggaucgggagcaagggcgacguguucgugauccgcgagcccuucaucuccugcagccaccucgagugccggacguucuuccugacccagggggcgcugcucaacgacaagcacuccuacggcaccagcaaggaccgcucccccuaccgggcccugaugagcugccccgucggcgaggccccgucccccuacaacagccgcuucgaguccguggccuggagcgccagcgcgugccacgacgggaugggcuggcugaccaucgggaucuccggccccgacaacggcgccguggccguccucaaguacaacgggaucaucacggagaccaucaagagcuggcggaagaagauccugcgcacccaggaguccgagugcacgugcgugaacggcagcugcuucaccaucaugaccgacgggcccuccgacggccuggccagcuacaagaucuucaagaucgagaaggggaaggugaccaaguccaucgagcucaacgcgccgaacagccacuacgaggagugcuccugcuaccccgacaccggcaaggucaugugcgugugccgggacaacuggcacggcagcaaccgccccuggguguccuucgaccagaaccuggacuaccagaucggguacaucugcagcggcgucuucggggacaacccccggccgaaggacggcacgggguccugcggccccgugagcgccgacggcgccaacggggugaagggcuucuccuaccgcuacgggaacggcgucuggaucgggcggaccaagagcgacuccagccgccacggcuucgagaugaucugggaccccaacggcuggaccgagaccgacucccgguucagcgugcgccaggacguggucgccaugacggaccggagcggguacuccggcagcuucgugcagcaccccgagcugaccgggcucgacugcaugcgcccgugcuucuggguggagcugauccggggccagcccgaggaggagaccaucuggaccuccggcagcaucaucuccuucugcggggucaacagcgacacgguggacugguccuggcccgacggcgccgagcugcccuucaccaucgacaaguga

SEQ ID NO: 83552 - RNA, 1410 nt, Artificial Sequence
  derived and/or modified sequence opt1 from neuraminidase__InfluenzaA__AFM68968
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcgcacccaggaguccgagugcgucugcaucaacgggaccugcacgguggugaugaccgacggcagcgccuccgagcgggcggacaccaagauccucuucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgccuccagcuacgucugcuccggccuggugggggacacgccccgcaagaacgaccggagcuccagcuccuacugccgcaaccccaacaacgagaagggcaaccacggggugaagggcugggccuucgacgacgggaacgacgucuggaugggccggaccaucagcgaggagucccgcagcggcuacgagaccuucaaggugaucgggggcugguccaccccgaacagcaagcuccagaucaaccggcaggucaucguggacuccgacaaccgcagcggguacuccggcaucuucagcguggagggcaagagcugcaucaaccggugcuucuacgucgagcugauccgcggccgcgagcaggagacccgggugugguggacguccaacagcaucguggucuucugcggcaccuccgggaccuacggcaccgggagcuggcccgacggcgccgacaucaaccugaugcccaucuga

SEQ ID NO: 83553 - RNA, 1410 nt, Artificial Sequence
  derived and/or modified sequence opt1 from neuraminidase__InfluenzaA__AFM68979
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcgggggcaucugggugacccgggagcccuacgucagcugcgacccggggaagugcuaccaguucgcccucggccagggcaccacccuggacaacaagcacuccaacgacacgauccacgaccgcacccccuaccggacccugcucaugaacgagcugggggugcccuuccaccugggcacccgccaggugugcaucgccuggagcuccagcuccugccacgacgggaaggccuggcuccacgucugcgugacgggcuacgacaagaacgcgaccgccagcuucaucuacgacgggcggcugguggacuccaucggcagcugguccaagaacauccugcgcacccaggagagcgagugcgucugcaucaacgggaccugcacgguggugaugaccgacggcuccgccagcgagcgggccgacaccaagauccucuucaucgaggagggcaagaucguccacaucagcccccuguccgggagcgcgcagcacguggaggagugcuccugcuacccgcgcuaccccggcgugcggugcgucugccgcgacaacuggaagggcagcaaccggcccgugguggacaucaacgucaaggacuacuccaucgugagcuccuacgugugcagcgggcuggucggcgacacgccccgcaagaacgaccgguccagcuccagcuacugccgcaacccgaacaacgagaaggggaaccacggcgugaaggggugggccuucgacgacggcaacgacgucuggaugggccggaccaucuccgaggagagccgcuccggguacgagaccuucaaggugaucggcggguggagcacccccaacuccaagcuccagaucaaccgccaggugaucgucgacagcgacaaccgguccggcuacagcgggaucuucagcguggagggcaaguccugcaucaaccggugcuucuacguggagcugauccgcggccgcgagcaggagacccgggucugguggacgagcaacuccaucgugguguucugcgggaccagcggcaccuacgggaccggcuccuggcccgacggggccgacaucaaccugaugcccaucuga

SEQ ID NO: 83554 - RNA, 1410 nt, Artificial Sequence; identical to SEQ ID NO: 83553
  derived and/or modified sequence opt1 from neuraminidase__InfluenzaA__AFM68990

SEQ ID NO: 83555 - RNA, 1410 nt, Artificial Sequence; identical to SEQ ID NO: 75821
  derived and/or modified sequence opt1 from neuraminidase__InfluenzaA__AFM71723

SEQ ID NO: 83556 - RNA, 1410 nt, Artificial Sequence; identical to SEQ ID NO: 83143
  derived and/or modified sequence opt1 from neuraminidase__InfluenzaA__AFM71734

SEQ ID NO: 83557 - RNA, 1410 nt, Artificial Sequence; identical to SEQ ID NO: 82957
  derived and/or modified sequence opt1 from neuraminidase__InfluenzaA__AFM71745

SEQ ID NO: 83558 - RNA, 1410 nt, Artificial Sequence; identical to SEQ ID NO: 79617
  derived and/or modified sequence opt1 from neuraminidase__InfluenzaA__AFM71771

SEQ ID NO: 83559 - RNA, 1410 nt, Artificial Sequence; identical to SEQ ID NO: 82643
  derived and/or modified sequence opt1 from neuraminidase__InfluenzaA__AFM71782

SEQ ID NO: 83560 - RNA, 1410 nt, Artificial Sequence; identical to SEQ ID NO: 82643
  derived and/or modified sequence opt1 from neuraminidase__InfluenzaA__AFM71794

SEQ ID NO: 83561 - RNA, 1410 nt, Artificial Sequence; identical to SEQ ID NO: 77607
  derived and/or modified sequence opt1 from neuraminidase__InfluenzaA__AFM71805

SEQ ID NO: 83562 - RNA, 1410 nt, Artificial Sequence
  derived and/or modified sequence opt1 from neuraminidase__InfluenzaA__AFM71827
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaaggacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 83563 - RNA, 1410 nt, Artificial Sequence; identical to SEQ ID NO: 80526
  derived and/or modified sequence opt1 from neuraminidase__InfluenzaA__AFM71838

SEQ ID NO: 83564 - RNA, 1365 nt, Artificial Sequence; identical to SEQ ID NO: 76727
  derived and/or modified sequence opt1 from neuraminidase__InfluenzaA__AFM71849

SEQ ID NO: 83565 - RNA, 1410 nt, Artificial Sequence; identical to SEQ ID NO: 75103
  derived and/or modified sequence opt1 from neuraminidase__InfluenzaA__AFM71860

SEQ ID NO: 83566 - RNA, 1410 nt, Artificial Sequence; identical to SEQ ID NO: 75335
  derived and/or modified sequence opt1 from neuraminidase__InfluenzaA__AFM71871

SEQ ID NO: 83567 - RNA, 1410 nt, Artificial Sequence; identical to SEQ ID NO: 75335
  derived and/or modified sequence opt1 from neuraminidase__InfluenzaA__AFM71882

SEQ ID NO: 83568 - RNA, 1410 nt, Artificial Sequence
  derived and/or modified sequence opt1 from neuraminidase__InfluenzaA__AFM71893
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggagucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggaccuccggcacguacgggaccggcagcuggcccgacggggccaacaucaacuucaugccgaucuga

SEQ ID NO: 83569 - RNA, 1410 nt, Artificial Sequence
  derived and/or modified sequence opt1 from neuraminidase__InfluenzaA__AFM71904
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgugaccauccacgaccgcaucccgcaccggacgcugcugaugaacgagcucggcguccccuuccaccuggggaccaagcaggucugcguggcguggagcuccagcuccugccacgacggcaaggccuggcugcacgugugcgugaccggggacgaccgcaacgccaccgccagcuucaucuacgacggccggcucguggacuccaucgggagcuggucccagaacauccugcgcacgcaggagagcgagugcgucugcaucaacgggaccugcaccguggugaugaccgacggcuccgcgagcggccgggccgacacgcgcauccuguucaucaaggagggcaagaucguccacaucagcccccucuccgggagcgcccagcacaucgaggagugcuccugcuacccccgguacccggacgugcgcugcaucugccgggacaacuggaagggcagcaaccgccccgugaucgacaucaacauggaggacuacuccaucgacagcggcuacgucugcuccgggcuggugggcgacacgccccggaacgacgacagcuccagcaacuccaacugccgcgaccccaacaacgagcgggggaacccgggcgugaaggggugggccuucgacaacggcgacgacgucuggaugggccgcaccaucaacaaggagagccgguccggguacgagaccuucaaggugaucggcggguggagcacccccaacuccaagagccaggucaaccgccaggugaucguggacaacaacaacugguccggcuacagcgggaucuucuccgucgagggcaagagcugcaucaaccggugcuucuacguggagcugauccgcggccgcccccaggagacccgggugugguggaccagcaacuccaucgucguguucugcgggaccagcggcacguacgggaccggcuccuggcccgacggggccaacaucaacuucaugccgaucuga

SEQ ID NO: 83570 - RNA, 1410 nt, Artificial Sequence; identical to SEQ ID NO: 75980
  derived and/or modified sequence opt1 from neuraminidase__InfluenzaA__AFM71915

SEQ ID NO: 83571 - RNA, 1410 nt, Artificial Sequence; identical to SEQ ID NO: 75980
  derived and/or modified sequence opt1 from neuraminidase__InfluenzaA__AFM71926

SEQ ID NO: 83572 - RNA, 1410 nt, Artificial Sequence; identical to SEQ ID NO: 75980
  derived and/or modified sequence opt1 from neuraminidase__InfluenzaA__AFM71937

SEQ ID NO: 83573 - RNA, 1410 nt, Artificial Sequence; identical to SEQ ID NO: 82988
  derived and/or modified sequence opt1 from neuraminidase__InfluenzaA__AFM71948

SEQ ID NO: 83574 - RNA, 1410 nt, Artificial Sequence; identical to SEQ ID NO: 82988
  derived and/or modified sequence opt1 from neuraminidase__InfluenzaA__AFM71959

SEQ ID NO: 83575 - RNA, 1410 nt, Artificial Sequence
  derived and/or modified sequence opt1 from neuraminidase__InfluenzaA__AFM71970
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccuacgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggagaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagccagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcaucugccgcgacaacuggaagggcuccaaccggcccgucguggacaucaacgugaaggacuacagcaucgacuccagcuacgucugcuccgggcuggugggcgacacgccccgcaagaacgaccggagcuccagcuccuacugccgcaaccccaacaacgagaaggggaaccacggcgugaaggggugggccuucgacgacggcaacgacgucuggaugggccggaccaucagcgaggacucccgcagcggguacgagaccuucaaggugaucggcgggugguccaccccgaacagcaagcuccagaucaaccggcaggucaucguggacuccgccaaccgcagcggcuacuccgggaucuucagcguggagggcaagagcugcaucaaccggugcuucuacgucgagcugauccgcggccgcgagcaggagacccgggugugguggacguccaacagcaucguggucuucugcgggaccuccggcaccuacgggaccggcagcuggcccgacggggccgacaucaaccugaugcccaucuga

SEQ ID NO: 83576 - RNA, 1410 nt, Artificial Sequence; identical to SEQ ID NO: 82996
  derived and/or modified sequence opt1 from neuraminidase__InfluenzaA__AFM71981

SEQ ID NO: 83577 - RNA, 1410 nt, Artificial Sequence
  derived and/or modified sequence opt1 from neuraminidase__InfluenzaA__AFM71992
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcuggucccaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaugaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 83578 - RNA, 1410 nt, Artificial Sequence; identical to SEQ ID NO: 83552
  derived and/or modified sequence opt1 from neuraminidase__InfluenzaA__AFM72013

SEQ ID NO: 83579 - RNA, 1365 nt, Artificial Sequence; identical to SEQ ID NO: 76727
  derived and/or modified sequence opt1 from neuraminidase__InfluenzaA__AFM72024

SEQ ID NO: 83580 - RNA, 1410 nt, Artificial Sequence; identical to SEQ ID NO: 80003
  derived and/or modified sequence opt1 from neuraminidase__InfluenzaA__AFM72035

SEQ ID NO: 83581 - RNA, 1410 nt, Artificial Sequence; identical to SEQ ID NO: 80003
  derived and/or modified sequence opt1 from neuraminidase__InfluenzaA__AFM72046

SEQ ID NO: 83582 - RNA, 1413 nt, Artificial Sequence
  derived and/or modified sequence opt1 from neuraminidase__InfluenzaA__AFM72057
augaaccccaaccagaagaucaucaccaucggcagcaucugcaccacgaucgggaucaucucccugauccuccagaucggcaacaucaucagcaucugggugucccacagcauccagaccgggucccagaaccacaccggcaucugcaaccagcgcaucaucaccuacgagaacagcacgugggucaaccagaccuacgugaacaucaacaacaccaacguggucgccgggaaggacaccacguccgugacccuggccggcaacagcucccugugcccgauccggggcugggcgaucuacagcaaggacaacuccauccgcaucgggagcaagggcgacguguucgucauccgggagcccuucaucuccugcagccaccucgagugccgcaccuucuuccugacccagggggcccugcucaacgacaagcacuccaacggcacggugaaggaccggagccccuaccgcgcccugauguccugccccaucggggaggccccgagccccuacaacucccgguucgagagcguggccuggagcgcguccgccugccacgacggcaugggcuggcugaccaucgggaucagcggccccgacgacggggccgucgccgugcucaaguacaacggcaucaucaccgagaccaucaaguccuggcgcaagcggauccugcgcacgcaggagagcgagugcgugugcgucaacggcuccugcuucaccaucaugaccgacgggcccagcaacggcccggcguccuaccggaucuucaagaucgagaaggggaagaucaccaagagcaucgagcuggacgcccccaacucccacuacgaggagugcagcugcuaccccgacacgggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagagcaacuccagccggaagggguucgagaugaucugggaccccaacggcuggacggacaccgacuccaacuuccuggucaagcaggacgugguggccaugaccgacuggagcggguacagcggcuccuucguccagcacccggagcugaccggccucgacugcaugcgccccugcuucuggguggagcugauccgggggcgcccccgggagaagacgaccaucuggaccagcggcuccagcaucuccuucugcggggucaacagcgacaccgccaacugguccuggcccgacggcgcggagcugccguucacgaucgacaaguga

SEQ ID NO: 83583 - RNA, 1413 nt, Artificial Sequence; identical to SEQ ID NO: 76067
  derived and/or modified sequence opt1 from neuraminidase__InfluenzaA__AFM72068

SEQ ID NO: 83584 - RNA, 1410 nt, Artificial Sequence
  derived and/or modified sequence opt1 from neuraminidase__InfluenzaA__AFM72090
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacagcauccgccuguccgccggcggggacaucugggugacccgggagcccuacgucagcugcgacccgggcaagugcuaccaguucgcccucgggcagggcaccacccugaacaacaagcacuccaacgacacggugcacgaccgcacccccuaccggacccugcucaugaacgagcugggcgugcccuuccaccuggggaccaagcaggucugcaucgccuggagcuccagcuccugccacgacggcaaggccuggcuccacgugugcgugacggggcacgacaagaacgcgaccgccagcuucaucuacgacggccgccuggucgacuccaucgggagcugguccaagaacauccugcggacccaggagagcgagugcgugugcaucaacgggaccugcacgguggucaugaccgacggcuccgccagcgagcgcgccgacaccaagauccucuucaucgaggagggcaagaucgugcacaucagcccccuguccggcagcgcgcagcacguggaggagugcuccugcuacccgcgguaccccgggguccgcugcgugugccgggacaacuggaagggcagcaaccgccccaucguggacaucaacgucaaggacuacuccaucgugagcuccuacgugugcagcggccuggucggggacacgccccggaagaacgaccgcuccagcuccagcuacugccggaacccgaacaacgagaagggcaaccacggggugaagggcugggccuucgacgacgggaacgacgucuggaugggccgcaccaucggcgaggagcuccggcugggguacgagaccuucaaggugaucggcgggugguccacccccaacagcaagcugcagaucaaccgccaggugaucgucgacuccaagaaccggagcggcuacuccgggaucuucagcguggagggcaaguccugcaucaaccgcugcuucuacguggagcucauccggggccgcgagcaggagacccgcgucugguggacgagcaacagcaucgugguguucugcgggaccuccggcaccuacgggaccggcagcuggcccgacggggccgacaucaaccugaugcccaucuga

SEQ ID NO: 83585 - RNA, 1410 nt, Artificial Sequence
  derived and/or modified sequence opt1 from neuraminidase__InfluenzaA__AFM72101
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggcgaugcccugcgagcccacgaucaucgagcgcaacaucaccgagaucguguaccucaccaacaccacgaucgagaaggagaucugcccgaagcuggucgaguaccggaacuggagcaagccccagugcaagaucaccggguucgcccccuucuccaaggacaacagcauccgccuguccgccggcggggacaucugggugacccgggagcccuacgugagcugcgacccgggcaagugcuaccaguucgcccucgggcagggcaccacgcugaacaaccgccacuccaacgacaccguccacgaccggacccccuaccgcacccugcucaugaacgagcugggcgugcccuuccaccuggggacgaagcaggucugcaucgccuggagcuccagcuccugccacgacggcaaggcguggcuccacgugugcgugaccgggcacgacaagaacgccaccgccagcuucaucuacgacggccggcugguggacuccaucgggagcugguccaagaacauccugcgcacccaggagagcgagugcgucugcaucaacggcacgugcaccguggugaugaccgacggcuccgccagcgagcgggcggacaccaagauccucuucaucgaggaggggaagaucguccacaucagcccccuguccggcagcgcccagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccuggugggggacacgccccgcaagaacgaccgguccagcuccagcuacugccgcaacccgaacaacgagaagggcucccacggggucaagggcugggccuucgacgacgggaacgacguguggaugggccggaccaucggcgaggagcuccgcagcggguacgagaccuucaaggucaucggcgggugguccacccccaacagcaagcugcagaucaaccgccaggugaucguggacuccggcaaccggagcggguacuccggcaucuucagcgucgagggcaagagcugcaucaaccggugcuucuacguggagcugauccgcgggcgcgagcaggagacgcgggugugguggaccuccaacagcaucgucguguucugcggcaccuccgggaccuacggcacggggagcuggcccgacggcgccgacaucaaccucaugcccaucuga

SEQ ID NO: 83586 - RNA, 1410 nt, Artificial Sequence; identical to SEQ ID NO: 75821
  derived and/or modified sequence opt1 from neuraminidase__InfluenzaA__AFM72112

SEQ ID NO: 83587 - RNA, 1410 nt, Artificial Sequence
  derived and/or modified sequence opt1 from neuraminidase__InfluenzaA__AFM72123
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacgucaaggacuacuccaucgugagcuccuacgugugcagcggccuggucggggacacgccccgcaagaacgaccgguccagcuccagcuacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacagcaagcugcagacgaaccgccaggugaucgucgacuccggcaaccggagcggguacuccggcaucuucagcguggagggcaagagcugcaucaaccggugcuucuacguggagcugauccgcgggcgcgagcaggagacccgggucugguggaccuccaacagcaucgugguguucugcggcaccuccgggacguacggcaccgggagcuggcccgacggcgccgacaucaaccucaugcccaucuga

SEQ ID NO: 83588 - RNA, 1410 nt, Artificial Sequence; identical to SEQ ID NO: 83143
  derived and/or modified sequence opt1 from neuraminidase__InfluenzaA__AFM72134

SEQ ID NO: 83589 - RNA, 1410 nt, Artificial Sequence
  derived and/or modified sequence opt1 from neuraminidase__InfluenzaA__AFM72145
augaaccccaaccagaagaucaucaccaucggcagcgugucccugaccaucgccacgaucugcuuccucaugcagaucgccauccuggcgaucaccgucacccugcacuucaagcaguacgagugcaacagcccgcccaacaaccaggugaugcucugcgagcccaccaucaucgagcgcaacacgaccgagaucguguaccugaccaacaccacgaucgagaaggaggucugccccaagcuggccgaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgcgugguccagcuccagcugccacgacggcaaggccuggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgcguccgagcgggccgacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcugcagaucaaccgccaggugaucguggaccgggggaaccgcagcggcuacuccgggaucuucagcgucgagggcaagagcugcaucaaccggugcuucuacguggagcucauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83590 - RNA, 1410 nt, Artificial Sequence; identical to SEQ ID NO: 76193
  derived and/or modified sequence opt1 from neuraminidase__InfluenzaA__AFM72156

SEQ ID NO: 83591 - RNA, 1410 nt, Artificial Sequence
  derived and/or modified sequence opt1 from neuraminidase__InfluenzaA__AFM72167
augaaccccaaccagaagaucaucaccaucggcagcaucucccugaccaucgccacgaucugcuuccucaugcagaucgccauccuggugaccaccgucacccugcacuucaagcaguacgagugcaacagcccgcccaacaaccaggugaugcucugcgagcccacgaucaucgagcgcaacaucaccgagaucguguaccugaccaacaccacgaucgagaaggagaucugccccgagcuggcggaguaccggaacugguccaagccgcagugcaagaucaccggguucgcccccuucagcaaggacaacuccauccgccucagcgccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgugugcaucaacggcacgugcaccgucgugaugaccgacggcagcgccuccgagcgggcggacaccaagauccuguucaucgaggaggggaagaucgugcacaucagcccccugagcggcuccgcccagcacgucgaggagugcagcugcuacccccgcuacccgggggugcggugcgugugccgcgacaacuggaagggcuccaaccggcccaucgucgacaucaacgugaaggacuacagcaucguguccagcuacgucugcuccggccucgugggggacacgccccgcaagaacgacagcuccagcuccagcuacugcuggaaccccaacaacgagaagggcgggcacggcgugaaggggugggccuucgacgacggcaacgacgucuggaugggccggaccaucuccgaggagcugcgcagcggguacgagaccuucaaggugaucggcgggugguccaagccgaacagcaagcugcagaucaaccggcaggucaucguggaccgcggcaaccgguccggguacagcggcaucuucuccguggagggcaagagcugcaucaaccgcugcuucuacgucgagcucauccgggggcgcaagcaggagaccgaggugugguggacgagcaacuccaucguggucuucugcggcaccagcgggaccuacggcaccggguccuggcccgacggcgccgacaucaaccugaugcccaucuga

SEQ ID NO: 83592 - RNA, 1410 nt, Artificial Sequence
  derived and/or modified sequence opt1 from neuraminidase__InfluenzaA__AFM72178
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccgagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugcuggaaccccaacaacgagaagggcgggcacggcgucaaggggugggccuucgacgacggcaacgacguguggaugggccggaccaucuccgaggagcugcgcagcggguacgagaccuucaaggucaucggcgggugguccaagccgaacagcaagcugcagaucaaccgccaggugaucguggaccggggcaaccgguccggguacagcggcaucuucuccgucgagggcaagagcugcaucaaccgcugcuucuacguggagcucauccgggggcgcaagcaggagaccgaggugugguggacgagcaacuccaucgucguguucugcggcaccagcgggaccuacggcaccggguccuggcccgacggcgccgacaucaaccugaugcccaucuga

SEQ ID NO: 83593 - RNA, 1410 nt, Artificial Sequence
  derived and/or modified sequence opt1 from neuraminidase__InfluenzaA__AFM72189
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccagcuccagcugccacgacgggaaggcguggcugcacgugugcgugaccggccacgacgagaacgccaccgccuccuucaucuacgacgggcggcugguggacagcaucggcuccuggagcaagaagauccuccgcacccaggaguccgagugcgucugcaucaacgggacgugcaccguggugaugaccgacggcagcgccuccggccgggcggacaccaagauccuguucaucgaggaggggaagaucguccacaucagcccccugcucggcagcgcccagcacguggaggagugcuccugcuacccccgcuacccgggggugcggugcgucugccgcgacaacuggaagggcagcaaccggcccaucguggacaucaacgugaaggacuacuccaucgucagcuccuacgugugcagcggccuggugggggacacgccccgcaagaacgacuccagcuccagcucccacugccugaaccccaacaacgaggagggcgggcacggcgucaaggggugggccuucgacgacggcgacgacguguggaugggccggaccaucagcgagaagcuccgcuccggguacgagaccuucaaggucaucgagggcuggagcaagccgaacuccaagcugcagaucaaccgccaggugaucguggaccgggggaaccggagcggcuacuccgggaucuucagcgucgagggcaaguccugcaucaaccgcugcuucuacguggagcugauccggggccgcaagcaggagaccgaggugugguggacgagcaacagcaucgucguguucugcgggaccuccggcaccuacgggaccggcagcuggcccgacggggccgacaucaaccucaugcccaucuga

SEQ ID NO: 83594 - RNA, 1410 nt, Artificial Sequence; identical to SEQ ID NO: 83593
  derived and/or modified sequence opt1 from neuraminidase__InfluenzaA__AFM72200

SEQ ID NO: 83595 - RNA, 1410 nt, Artificial Sequence; identical to SEQ ID NO: 76757
  derived and/or modified sequence opt1 from neuraminidase__InfluenzaA__AFM72211

SEQ ID NO: 83596 - RNA, 1410 nt, Artificial Sequence; identical to SEQ ID NO: 76757
  derived and/or modified sequence opt1 from neuraminidase__InfluenzaA__AFM72222

SEQ ID NO: 83597 - RNA, 1413 nt, Artificial Sequence; identical to SEQ ID NO: 77461
  derived and/or modified sequence opt1 from neuraminidase__InfluenzaA__AFM72233

SEQ ID NO: 83598 - RNA, 1410 nt, Artificial Sequence; identical to SEQ ID NO: 75581
  derived and/or modified sequence opt1 from neuraminidase__InfluenzaA__AFM72249

SEQ ID NO: 83599 - RNA, 1410 nt, Artificial Sequence; identical to SEQ ID NO: 75069
  derived and/or modified sequence opt1 from neuraminidase__InfluenzaA__AFM72260

SEQ ID NO: 83600 - RNA, 1410 nt, Artificial Sequence; identical to SEQ ID NO: 75069
  derived and/or modified sequence opt1 from neuraminidase__InfluenzaA__AFM72271

SEQ ID NO: 83601 - RNA, 1410 nt, Artificial Sequence
  derived and/or modified sequence opt1 from neuraminidase__InfluenzaA__AFM72293
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacuacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcagccuguccgggagcgcccagcacguggaggagugcuccugcuacccccgcuaccccggcgugcggugcgucugccgcgacaacuggaagggcagcaaccggccgaucguggacaucaacgugaaggacuacuccaucgucagcuccuacgugugcagcgggcucgugggcgacacgccccgcaagaacgacuccagcuccagcucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggagcaagcccaacuccaagcuccagaucaaccgccaggugaucguggaccggggcaaccggagcggguacuccggcaucuucagcgucgagggcaagagcugcaucaaccgcugcuucuacguggagcugauccgggggcgcaagcaggagaccgaggugcuguggaccuccaacagcaucgucguguucugcggcaccuccgggaccuacggcacggggagcuggccggacggcgccgacaucaaccucaugcccaucuga

SEQ ID NO: 83602 - RNA, 1410 nt, Artificial Sequence; identical to SEQ ID NO: 76937
  derived and/or modified sequence opt1 from neuraminidase__InfluenzaA__AFM72304

SEQ ID NO: 83603 - RNA, 1410 nt, Artificial Sequence
  derived and/or modified sequence opt1 from neuraminidase__InfluenzaA__AFM72315
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgagaagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccgggacaaccggagcggcuacuccgggaucuucagcgucgagggcaagagcugcaucaaccgcugcuucuacguggagcucauccgggggcgcaaccaggagaccgaggugcuguggaccuccaacagcaucgucguguucugcggcaccuccggcacguacgggaccggcagcuggccggacggggccgacaucaaccugaugcccaucuga

SEQ ID NO: 83604 - RNA, 1410 nt, Artificial Sequence
  derived and/or modified sequence opt1 from neuraminidase__InfluenzaA__AFM72326
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaaguuccagaucaaccgccaggugaucguggaccgggacaaccggagcggcuacuccgggaucuucagcgucgagggcaagagcugcaucaaccgcugcuucuacguggagcugauccgggggcgcaaccaggagaccgaggugcucuggaccuccaacagcaucgucguguucugcggcaccuccggcacguacgggaccggcagcuggccggacggggccgacaucaaccugaugcccaucuga

SEQ ID NO: 83605 - RNA, 1410 nt, Artificial Sequence
  derived and/or modified sequence opt1 from neuraminidase__InfluenzaA__AFM72337
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 83606 - RNA, 1410 nt, Artificial Sequence
  derived and/or modified sequence opt1 from neuraminidase__InfluenzaA__AFM72348
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcauccccuuccaccucgggacgcgccaggugugcaucgccugguccagcuccagcugccacgacggcaaggcguggcugcacgugugcgucaccggggacgacaagaacgccaccgccuccuucaucuacaacggccggcugguggacagcaucggguccuggagcaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucagcacgcugagcggguccgcccagcacgucgaggagugcagcugcuacccccgguaccccggcgugcgcugcgugugccgggacaacuggaagggcuccaaccgcccgaucgucgacaucaacgugaaggacuacagcaucguguccagcuacgucugcuccgggcucgugggcgacacgccccggaagaacgacagcuccagcuccagccacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacagcaagcuccagaucaaccgccaggucaucguggagcggggcaaccgcuccggguacagcggcaucuucuccguggagggcaagagcugcaucaaccggugcuucuacgucgagcugauccgcgggcggaaggaggagaccgaggugugguggaccagcaacuccaucguggucuucugcggcaccagcgggaccuacggcacgggguccuggccggacggcgccgacaucaaccugaugcccaucuga

SEQ ID NO: 83607 - RNA, 1410 nt, Artificial Sequence
  derived and/or modified sequence opt1 from neuraminidase__InfluenzaA__AFM72359
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccaaggugcuguggaccuccaacagcaucgucguguucugcggcaccuccgggacguacggcaccgggagcuggccggacggcgccgacaucaaccugaugcccaucuga

SEQ ID NO: 83608 - RNA, 1410 nt, Artificial Sequence; identical to SEQ ID NO: 83607
  derived and/or modified sequence opt1 from neuraminidase__InfluenzaA__AFM72370

SEQ ID NO: 83609 - RNA, 1410 nt, Artificial Sequence; identical to SEQ ID NO: 80526
  derived and/or modified sequence opt1 from neuraminidase__InfluenzaA__AFM72381

SEQ ID NO: 83610 - RNA, 1410 nt, Artificial Sequence; identical to SEQ ID NO: 80526
  derived and/or modified sequence opt1 from neuraminidase__InfluenzaA__AFM72392

SEQ ID NO: 83611 - RNA, 1410 nt, Artificial Sequence; identical to SEQ ID NO: 77410
  derived and/or modified sequence opt1 from neuraminidase__InfluenzaA__AFM72403

SEQ ID NO: 83612 - RNA, 1410 nt, Artificial Sequence; identical to SEQ ID NO: 77410
  derived and/or modified sequence opt1 from neuraminidase__InfluenzaA__AFM72414

SEQ ID NO: 83613 - RNA, 1410 nt, Artificial Sequence; identical to SEQ ID NO: 77074
  derived and/or modified sequence opt1 from neuraminidase__InfluenzaA__AFM72425

SEQ ID NO: 83614 - RNA, 1410 nt, Artificial Sequence; identical to SEQ ID NO: 77074
  derived and/or modified sequence opt1 from neuraminidase__InfluenzaA__AFM72436

SEQ ID NO: 83615 - RNA, 1410 nt, Artificial Sequence; identical to SEQ ID NO: 77074
  derived and/or modified sequence opt1 from neuraminidase__InfluenzaA__AFM72447

SEQ ID NO: 83616 - RNA, 1410 nt, Artificial Sequence; identical to SEQ ID NO: 77074
  derived and/or modified sequence opt1 from neuraminidase__InfluenzaA__AFM72458

SEQ ID NO: 83617 - RNA, 1410 nt, Artificial Sequence; identical to SEQ ID NO: 77074
  derived and/or modified sequence opt1 from neuraminidase__InfluenzaA__AFM72469

SEQ ID NO: 83618 - RNA, 1410 nt, Artificial Sequence
  derived and/or modified sequence opt1 from neuraminidase__InfluenzaA__AFM72491
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugaugugcgagcccacgaucaucgagcgcaacaucaccgagaucguguaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacgacaccguccgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccaucgugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcucggcuacgagaccuucaaggugaucgagggguggagcaaccccaacuccaagcugcagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcucuggaccuccaacagcaucguggucuucugcggcaccuccgggacguacggcaccgggagcuggccggacggcgccgacaucaaccugaugcccaucuga

SEQ ID NO: 83619 - RNA, 1410 nt, Artificial Sequence; identical to SEQ ID NO: 83618
  derived and/or modified sequence opt1 from neuraminidase__InfluenzaA__AFM72502

SEQ ID NO: 83620 - RNA, 1413 nt, Artificial Sequence; identical to SEQ ID NO: 77640
  derived and/or modified sequence opt1 from neuraminidase__InfluenzaA__AFM72513

SEQ ID NO: 83621 - RNA, 1413 nt, Artificial Sequence; identical to SEQ ID NO: 77640
  derived and/or modified sequence opt1 from neuraminidase__InfluenzaA__AFM72524

SEQ ID NO: 83622 - RNA, 1413 nt, Artificial Sequence; identical to SEQ ID NO: 77640
  derived and/or modified sequence opt1 from neuraminidase__InfluenzaA__AFM72535

SEQ ID NO: 83623 - RNA, 1413 nt, Artificial Sequence; identical to SEQ ID NO: 77640
  derived and/or modified sequence opt1 from neuraminidase__InfluenzaA__AFM72546

SEQ ID NO: 83624 - RNA, 1413 nt, Artificial Sequence; identical to SEQ ID NO: 77640
  derived and/or modified sequence opt1 from neuraminidase__InfluenzaA__AFM72557

SEQ ID NO: 83625 - RNA, 1410 nt, Artificial Sequence
  derived and/or modified sequence opt1 from neuraminidase__InfluenzaA__AFM72579
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacgcaggagagcgagugcgucugcaucaacgggaccugcaccguggugaugaccgacggguccgccagcggcaaggccgacacgaagauccucuucaucgaggagggcaagaucguccacaccagcauccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcggccacggggugaagggcugggccuucgacgacgggaacgacgucuggaugggccggaccaucagcgagaagucccgccugggcuacgagaccuucaaggugaucgagggguggagcaaccccaaguccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 83626 - RNA, 1413 nt, Artificial Sequence
  derived and/or modified sequence opt1 from neuraminidase__InfluenzaA__AFM72802
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaugugcaaccagcgcaucaucaccuacgagaacuccaccugggugaaccacaccuacgucaacaucaacaacacgaacgugguggcggggaaggacaagaccccggucacccuggccggcaacagcucccugugcagcaucuccggcugggccauccacaccaaggacaacagcauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacagcaaguucgagagcguggccugguccgccagcgccugccacgacggcaucggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggagcugcuucaccaucaugacggacggccccuccaacggggccgccagcuacaagaucuucaagaucgagaagggcaaggugaucaaguccauggagcucaacgccccgaacuuccacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccggaggacggggagggcagcugcaaccccgugaccguggacggggcgaacggcgucaagggcuucuccuacaaguacgggaacggcguguggaucgggcggaccaagagcaaccgcauccggaagggcuucgagaugaucugggaccccaacggguggacgaacaccgacuccgacuucagcgugaagcaggacaucgucgccaucaccgacugguccggcuacagcggcagcuucgugcagcaccccgagcugacggggcucgacugcauccgcccgugcuucuggguggagcugguccggggccugccccgcgagaacaccaccaucuggaccuccgggagcuccaucagcuucugcggcgugaacuccgacaucgccaacuggagcuggcccgacggcgccgagcuccccuucacgaucgacaaguga

SEQ ID NO: 83627 - RNA, 1413 nt, Artificial Sequence; identical to SEQ ID NO: 83626
  derived and/or modified sequence opt1 from neuraminidase__InfluenzaA__AFM72813

SEQ ID NO: 83628 - RNA, 1413 nt, Artificial Sequence; identical to SEQ ID NO: 83626
  derived and/or modified sequence opt1 from neuraminidase__InfluenzaA__AFM72824

SEQ ID NO: 83629 - RNA, 1410 nt, Artificial Sequence; identical to SEQ ID NO: 77736
  derived and/or modified sequence opt1 from neuraminidase__InfluenzaA__AFM72835

SEQ ID NO: 83630 - RNA, 1410 nt, Artificial Sequence; identical to SEQ ID NO: 77736
  derived and/or modified sequence opt1 from neuraminidase__InfluenzaA__AFM72845

SEQ ID NO: 83631 - RNA, 1410 nt, Artificial Sequence; identical to SEQ ID NO: 77736
  derived and/or modified sequence opt1 from neuraminidase__InfluenzaA__AFM72855

SEQ ID NO: 83632 - RNA, 1410 nt, Artificial Sequence; identical to SEQ ID NO: 77736
  derived and/or modified sequence opt1 from neuraminidase__InfluenzaA__AFM72865

SEQ ID NO: 83633 - RNA, 1410 nt, Artificial Sequence
  derived and/or modified sequence opt1 from neuraminidase__InfluenzaA__AFM72875
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaaguccgacagcuccagcuccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccguguga

SEQ ID NO: 83634 - RNA, 1410 nt, Artificial Sequence; identical to SEQ ID NO: 77607
  derived and/or modified sequence opt1 from neuraminidase__InfluenzaA__AFM72886

SEQ ID NO: 83635 - RNA, 1410 nt, Artificial Sequence; identical to SEQ ID NO: 77607
  derived and/or modified sequence opt1 from neuraminidase__InfluenzaA__AFM72897

SEQ ID NO: 83636 - RNA, 1410 nt, Artificial Sequence
  derived and/or modified sequence opt1 from neuraminidase__InfluenzaA__AFM72908
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaccaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccguguga

SEQ ID NO: 83637 - RNA, 1410 nt, Artificial Sequence
  derived and/or modified sequence opt1 from neuraminidase__InfluenzaA__AFM72919
augaaccccaaccagaagaucaucaccaucggcagcgugucccugaccaucagcacgaucugcuucuucaugcagaucgccauccucaucaccaccgucacccugcacuucaagcagcacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaccaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccguguga

SEQ ID NO: 83638 - RNA, 1410 nt, Artificial Sequence; identical to SEQ ID NO: 78913
  derived and/or modified sequence opt1 from neuraminidase__InfluenzaA__AFM72930

SEQ ID NO: 83639 - RNA, 1410 nt, Artificial Sequence; identical to SEQ ID NO: 78913
  derived and/or modified sequence opt1 from neuraminidase__InfluenzaA__AFM72941

SEQ ID NO: 83640 - RNA, 1410 nt, Artificial Sequence; identical to SEQ ID NO: 78913
  derived and/or modified sequence opt1 from neuraminidase__InfluenzaA__AFM72952

SEQ ID NO: 83641 - RNA, 1410 nt, Artificial Sequence; identical to SEQ ID NO: 78913
  derived and/or modified sequence opt1 from neuraminidase__InfluenzaA__AFM72963

SEQ ID NO: 83642 - RNA, 1410 nt, Artificial Sequence; identical to SEQ ID NO: 78913
  derived and/or modified sequence opt1 from neuraminidase__InfluenzaA__AFM72974

SEQ ID NO: 83643 - RNA, 1410 nt, Artificial Sequence; identical to SEQ ID NO: 80526
  derived and/or modified sequence opt1 from neuraminidase__InfluenzaA__AFM72985

SEQ ID NO: 83644 - RNA, 1410 nt, Artificial Sequence; identical to SEQ ID NO: 80526
  derived and/or modified sequence opt1 from neuraminidase__InfluenzaA__AFM72996

SEQ ID NO: 83645 - RNA, 1410 nt, Artificial Sequence; identical to SEQ ID NO: 80526
  derived and/or modified sequence opt1 from neuraminidase__InfluenzaA__AFM73007

SEQ ID NO: 83646 - RNA, 1410 nt, Artificial Sequence
  derived and/or modified sequence opt1 from neuraminidase__InfluenzaA__AFM73018
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggaucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 83647 - RNA, 1410 nt, Artificial Sequence; identical to SEQ ID NO: 83646
  derived and/or modified sequence opt1 from neuraminidase__InfluenzaA__AFM73028

SEQ ID NO: 83648 - RNA, 1410 nt, Artificial Sequence; identical to SEQ ID NO: 83646
  derived and/or modified sequence opt1 from neuraminidase__InfluenzaA__AFM73038

SEQ ID NO: 83649 - RNA, 1410 nt, Artificial Sequence; identical to SEQ ID NO: 79481
  derived and/or modified sequence opt1 from neuraminidase__InfluenzaA__AFM73048

SEQ ID NO: 83650 - RNA, 1410 nt, Artificial Sequence
  derived and/or modified sequence opt1 from neuraminidase__InfluenzaA__AFM73058
augaaccccaaccagaagaucaucaccaucggcagcuucugcaugaccaucgggcuggccaaccucauccugcagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcucgccgggaacagcucccugugcccggugagcggcugggccaucuacuccaaggacaacagcguccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaagaacuucagcaucaagcaggacaucguggggaucaacgagugguccggcuacagcggguccuucgugcagcacccggagcugacgggccucgacugcauccggcccugcuucugggucgagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 83651 - RNA, 1410 nt, Artificial Sequence; identical to SEQ ID NO: 79481
  derived and/or modified sequence opt1 from neuraminidase__InfluenzaA__AFM73068

SEQ ID NO: 83652 - RNA, 1413 nt, Artificial Sequence; identical to SEQ ID NO: 75959
  derived and/or modified sequence opt1 from neuraminidase__InfluenzaA__AFM73480

SEQ ID NO: 83653 - RNA, 1350 nt, Artificial Sequence
  derived and/or modified sequence opt1 from neuraminidase__InfluenzaA__AFM78569
augaaccccaaccagaagaucaucaccaucggcagcaucugcauggugaucgggaucgucucccugaugcuccagaucggcaacaugaucagcaucugggugauccacuccauccagaccgggaaccagcaccaggccgagagcaucuccaacacgaacccgcugaccgagaaggccguggcgagcgucacccuggccggcaacuccagccucugccccauccgcgggugggccgugcacuccaaggacaacaacauccggaucggcagcaagggcgacguguucgucauccgcgagcccuucaucuccugcagccaccuggagugccggaccuucuuccugacgcagggggcccuccugaacgacaagcacuccaacggcaccgugaaggaccgcagcccccaccggacccugauguccugcccggugggggaggcccccagccccuacaacucccgcuucgagagcgucgcgugguccgccagcgccugccacgacggcaccagcuggcucacgaucgggaucuccggccccgacaacgaggccguggcggugcugaaguacaacggcaucaucaccgacaccaucaagagcuggcggaacgacauccugcgcacccaggaguccgagugcgccugcgucaacgggagcugcuucacggugaugaccgacggcccguccaacgggcaggccagcuacaagaucuucaagauggagaagggcaagguggucaaguccguggagcucgacgcccccaacuaccacuacgaggagugcagcugcuaccccgacgccggcgagaucacgugcgugugccgggacaacuggcacggguccaaccgccccugggucagcuucaaccagaaccuggaguaccagaucggcuacaucugcuccgggguguucggcgacaacccgcggcccaacgacgggaccggcagcugcggccccaugucccccaacggggcguacggcgugaagggguucagcuucaaguacggcaacggggucuggaucggccgcaccaaguccaccaacagccgguccggcuucgagaugaucugggacccgaacggguggaccggcaccgacagcuccuucagcgugaagcaggacaucguggccaucacggacuggagcggguacuccggcagcuucguccagcaccccgagcugaccgggcucgacugcauccgccccugcuucuggguggagcugauccggggccgccccaaggaguccaccaucuggaccagcggcuccagcaucuccuucugcggggucaacagcgacacgguguccuggagcuggccggacggcgccgagcugcccuucaccaucgacaaguga

SEQ ID NO: 83654 - RNA, 1410 nt, Artificial Sequence
  derived and/or modified sequence opt1 from neuraminidase__InfluenzaA__AFM85180
augaaccccaaccagaagaucaucaccaucggcagcgugucccugaccaucgccacgaucugcuuccucacccagaucgccauccuggucaccaccgugacgcugcacuucaagcaguacgagugcaacagcuccccgaacaaccaggugaugcucugcgagcccaccaucaucgagcgcaacaucaccgagaucgucuaccugaccaacacgaccaucgagaaggagaucugccccaagcuggcggaguaccggaacuggagcaagccccagugcaacaucaccggguucgccccguucuccaaggacaacagcauccgccucuccgccggcggggacaucugggugacccgggagcccuacgugagcugcggccccgacaagugcuaccaguucgcccuggggcagggcacgacccugaacaacggccacuccaacgacaccguccacgaccgcacccccuaccggacgcuccugaugaacgagcugggggugccguuccaccucggcaccaagcaggucugcaucgccuggagcuccagcuccugccacgacgggaaggcguggcugcacgugugcgugaccggcgacgacaagaacgccaccgccagcuucaucuacaacgggcgccugguggacuccaucggcagcugguccaagaagauccuccggacgcaggagagcgagugcgucugcaucaacgggaccugcaccguggugaugaccgacggguccgccagcggcaaggcggacacgaagauccuguucaucgaggaggggaagaucguccacaccagccugcucuccggcagcgcccagcacguggaggagugcuccugcuacccccgcuaccccggcgugcggugcgucugccgcgacaacuggaaggggagcaaccggcccaucguggacaucaacgugaaggacuacuccaucgucagcuccuacgugugcagcggccuggugggggacaccccgcgcaagaacgacuccagcuccagcucccacugccuggaccccaacaacgaggagggcgggcacggcgucaagggcugggccuucgacgacgggaacgacguguggaugggccggaccaucagcgagaagcuccgcuccggguacgagacguucaaggucaucgagggcuggagcaagcccaacuccaagcugcagaucaaccgccaggugaucguggaccgggggaaccggagcggcuacuccggcaucuucagcgucgagggcaagagcugcaucaaccgcugcuucuacguggagcugauccggggccgcaaccaggagaccgaggugcucuggaccuccaacagcaucgucguguucugcgggaccuccggcacguacgggaccggcagcuggcccgacggcgccgacaucaaccugaugccgaucuga

SEQ ID NO: 83655 - RNA, 1410 nt, Artificial Sequence; identical to SEQ ID NO: 75111
  derived and/or modified sequence opt1 from neuraminidase__InfluenzaA__AFN11830

SEQ ID NO: 83656 - RNA, 1410 nt, Artificial Sequence
  derived and/or modified sequence opt1 from neuraminidase__InfluenzaA__AFN11831
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugagcgccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccagcuccagcugccacgacggcaaggcguggcuccacgucugcgugacgggguacgacaagaacgccaccgccuccuucaucuacgacggccggcugguggacagcaucggguccuggagcaagaacauccugcgcacccaggaguccgagugcgucugcaucaacgggaccugcacgguggugaugaccgacggcagcgccuccggccgggcggacaccaagauccucuucaucgaggagggcaagaucguccacaucagcccccugagcggguccgcccagcacguggaggagugcagcugcuacccccgcuacccgggcgugcggugcgucugccgcgacaacuggaagggcuccaaccggcccgugguggacaucaacgucaaggacuacagcaucguguccagcuacgugugcuccgggcuggucggcgacacgccccgcaacaacgaccggagcuccagcuccuacugccgcaaccccaacaacgagaaggggaaccacggcgugaaggggugggccuucgacgacggcaacgacgucuggaugggccggaccaucagcgaggagucccgcagcggguacgagaccuucaaggugaucggcgggugguccaccccgaacagcaagcuccagaucaaccgccaggugaucgucgacuccgacaaccggagcggcuacuccgggaucuucagcguggagggcaagagcugcaucaaccggugcuucuacguggagcugauccgcggccgcgagcaggagacccgggucugguggacguccaacagcaucgugguguucugcgggaccuccggcaccuacgggaccggcagcuggcccgacggggccgacaucaaccugaugcccaucuga

SEQ ID NO: 83657 - RNA, 1410 nt, Artificial Sequence; identical to SEQ ID NO: 75584
  derived and/or modified sequence opt1 from neuraminidase__InfluenzaA__AFN11833

SEQ ID NO: 83658 - RNA, 1410 nt, Artificial Sequence; identical to SEQ ID NO: 77519
  derived and/or modified sequence opt1 from neuraminidase__InfluenzaA__AFN11835

SEQ ID NO: 83659 - RNA, 1410 nt, Artificial Sequence
  derived and/or modified sequence opt1 from neuraminidase__InfluenzaA__AFN11836
augaaccccaaccagaagaucaucaccaucggcagcgugucccugaccaucgccacgaugugcuuccucaugcagaucgccauccuggucaccaccgugacccugcacuucaagcaguacgagugcagcuccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacaagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucauccacaucagcccccuguccggcagcgcgcagcacguggaggagugcuccugcuacccgcgcuaccccggggugcggugcgucugccgcgacaacuggaagggcagcaaccggcccaucguggacaucaacgugaaggacuacuccaucgucagcuccuacgugugcagcggccuggugggggacacgccccgcaagaacgaccgguccagcuccagcuacugccgcaacccgaacaacgagaagggcucccacggggucaagggcugggccuucgacgacgggaacgacguguggaugggccggaccaucggcgaggagcuccgcagcggguacgagaccuucaaggucaucggcgggugguccacccccaacagcaagcugcagaucaaccgccaggugaucguggacuccggcaaccggagcggguacuccggcaucuucagcgucgagggcaagagcugcaucaaccggugcuucuacguggagcugauccgcgggcgcgagcaggagacgcgggugugguggaccuccaacagcaucgucguguucugcggcaccuccgggaccuacggcacggggagcuggcccgacggcgccgacaucaaccucaugcccaucuga

SEQ ID NO: 83660 - RNA, 1410 nt, Artificial Sequence
  derived and/or modified sequence opt1 from neuraminidase__InfluenzaA__AFN11839
augaaccccaaccagaagaucaucaccaucggcagcgugucccugaccaucgccacgaucugcuuccucaugcagaucgccauccuggucaccaccgugacccugcacuucaagcaguacgagugcagcuccccgcccaacaaccaggugaugcccugccagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacagcauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccagcuccugccacgacggcaaggccuggcuccacgugugcgugaccgggcacgacgagaacgcgaccgccagcuucaucuacgacggccggcuggucgacuccaucgggagcugguccaagaacauccugcgcacccaggagagcgagugcgugugcaucaacggcacgugcaccguggucaugaccgacggcuccgccagcgagcgggccgacaccaagauccucuucaucgaggaggggaagaucgugcacaucagcccccuguccggcagcgcgcagcacguggaggagugcuccugcuacccgcgcuaccccgggguccggugcgugugccgcgacaacuggaagggcagcaaccggcccaucguggacaucaacaugaaggacuacuccaucgucagcuccuacgugugcagcggccuggugggggacacgccccgcaagaacgacuccagcuccagcuccuacugccggaacccgaacaacgagaagggcagccacggggucaagggcugggccuucgacgacgggaacgacguguggaugggccgcaccaucuccgaggagcuccggagcggcuacgagaccuucaaggucaucgggggcugguccacccccaacagcaagcugcagaucaaccgccaggugaucguggacuccgggaaccggagcggcuacagcgggaucuucuccgucgagggcaagagcugcaucaaccgcugcuucuacguggagcugauccggggccgcaagcaggagacgaaggugugguggaccuccaacagcaucgucguguucugcgggaccuccggcaccuacgggacgggcagcuggcccgacggggccgacaucaaccucaugcccaucuga

SEQ ID NO: 83661 - RNA, 1410 nt, Artificial Sequence
  derived and/or modified sequence opt1 from neuraminidase__InfluenzaA__AFN11840
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucagcgccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccagcuccagcugccacgacggcaaggcguggcugcacgugugcgugaccgggcacgacgagaacgccaccgccuccuucaucuacgacggccggcugguggacagcaucggguccuggagcaagaacauccuccgcacccaggaguccgagugcgucugcaucaacggcacgugcaccguggugaugaccgacggcagcgccuccgagcgggcggacaccaagauccuguucaucgaggaggggaagaucguccacaucagcccccugagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccucgugggggacacgccccgcaagaacgacagcuccagcuccagcuacugccggaaccccaacaacgagaagggcucccacggggucaagggcugggccuucgacgacgggaacgacguguggaugggccgcaccaucggcgaggagcugcggagcggguacgagaccuucaaggucaucggcgggugguccaccccgaacagcaagcugcagaucaaccgccaggugaucguggaccggggcaaccgcuccggguacagcggcaucuucuccgucgagggcaagagcugcaucaaccggugcuucuacguggagcucgugcgcgggcgcaagcaggagacggaggucugguggaccagcaacuccaucgugguguucugcggcaccagcgggaccuacggcacgggguccuggcccgacggcgccgacaucaaccugaugcccaucuga

SEQ ID NO: 83662 - RNA, 1410 nt, Artificial Sequence; identical to SEQ ID NO: 76937
  derived and/or modified sequence opt1 from neuraminidase__InfluenzaA__AFN11841

SEQ ID NO: 83663 - RNA, 1410 nt, Artificial Sequence; identical to SEQ ID NO: 83025
  derived and/or modified sequence opt1 from neuraminidase__InfluenzaA__AFN11842

SEQ ID NO: 83664 - RNA, 1410 nt, Artificial Sequence
  derived and/or modified sequence opt1 from neuraminidase__InfluenzaA__AFN11844
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucgggcugaugcccauguga

SEQ ID NO: 83665 - RNA, 1410 nt, Artificial Sequence; identical to SEQ ID NO: 83584
  derived and/or modified sequence opt1 from neuraminidase__InfluenzaA__AFN11845

SEQ ID NO: 83666 - RNA, 1410 nt, Artificial Sequence; identical to SEQ ID NO: 83112
  derived and/or modified sequence opt1 from neuraminidase__InfluenzaA__AFN11847

SEQ ID NO: 83667 - RNA, 1410 nt, Artificial Sequence
  derived and/or modified sequence opt1 from neuraminidase__InfluenzaA__AFN11848
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgggcccaacaacgaggagggcgggcacggcgucaaggggugggccuucgacgacggcaacgacguguggaugggccggaccaucagcgagaagcugcgcuccggguacgagaccuucaaggucaucgagggcuggagcaaccccaacuccaagcugcagaucaaccgccaggugaucguggaccgggggaaccggagcggcuacuccgggaucuucagcgucgagggcaagagcugcaucaaccgcugcuucuacguggagcucauccggggccgcaagcaggagaccgaggugcuguggaccuccaacagcaucgucguguucugcgggaccuccggcacguacgggaccggcagcuggccggacggggccgacaucaaccugaugcccaucuga

SEQ ID NO: 83668 - RNA, 1410 nt, Artificial Sequence
  derived and/or modified sequence opt1 from neuraminidase__InfluenzaA__AFN11850
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccacaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggcccgacggggccgaccugaaccucaugccgaucuga

SEQ ID NO: 83669 - RNA, 1410 nt, Artificial Sequence
  derived and/or modified sequence opt1 from neuraminidase__InfluenzaA__AFN11851
augaaccccaaccagaagaucaucaccaucggcagcgugucccugaccaucgccacgaucugccuccugaugcagaucgccauccuggucaccaccgugacccuccacuucaagcaguacgagugcaacagcccgcccaacaaccaggugaugcugugcgagcccacgaucaucgagcgcaacaucaccaagaucgucuaccugaccaacaccacgaucgagaaggagaucugccccaagcucgcggaguaccggaacugguccaagccgcagugcaagaucaccggguucgcccccuucagcaaggacaacuccauccgccugagcgccggcggggacaucugggugacccgggagcccuacguguccugcgaccccggcaagugcuaccaguucgcccuggggcagggcaccacgcucaacaaccgccacagcaacgacaccguccacgaccggaccccguaccgcacccugcugaugaacgagcucggcgugcccuuccaccuggggacgaagcaggucugcaucgccugguccagcuccagcugccacgacggcaaggcguggcugcacgugugcgugaccgggcacgacgagaacgccaccgccuccuucaucuacgacggccggcucguggacagcaucggguccuggagcaagaacauccugcgcacccaggaguccgagugcgucugcaucaacggcacgugcaccguggugaugaccgacggcagcgccuccgagcgggcggacaccaagauccuguucaucgaggaggggaagaucguccacaucagcccccucagcggcuccgcccagcacguggaggagugcagcugcuacccccgcuacccgggggugcggugcgucugccgcgacaacuggaagggcuccaaccggcccaucguggacaucaacgugaaggacuacagcaucgucuccagcuacgugugcuccggccuggugggggacacgccccgcaagaacgacagcuccagcuccagcuacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggagcaagccgaacuccaagcuccagaucaaccgccaggugaucguggaccgggggaaccgcagcggcuacuccgggaucuucagcgucgagggcaagagcugcaucaaccggugcuucuacguggagcugauccgcggccgcaagcaggagaccgaggugugguggacguccaacagcaucgucguguucugcgggaccuccggcaccuacgggaccggcagcuggcccgacggggccgacaucaaccugaugcccaucuga

SEQ ID NO: 83670 - RNA, 1410 nt, Artificial Sequence; identical to SEQ ID NO: 75335
  derived and/or modified sequence opt1 from neuraminidase__InfluenzaA__AFN11853

SEQ ID NO: 83671 - RNA, 1410 nt, Artificial Sequence
  derived and/or modified sequence opt1 from neuraminidase__InfluenzaA__AFN11855
augaaccccaaccagaagaucaucaccaucggcagcgugucccugaccaucagcacgaucugcuucuucaugcagaccgccauccucaucaccaucgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcauccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucagcgagaagucccgccugggcuacgagaccuucaaggugaucgagggguggagcaaccccaaguccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcaccuccgggaccuacggcacggggagcuggccggacggcgccgacaucaaccugaugcccaucuga

SEQ ID NO: 83672 - RNA, 1410 nt, Artificial Sequence; identical to SEQ ID NO: 76937
  derived and/or modified sequence opt1 from neuraminidase__InfluenzaA__AFN11857

SEQ ID NO: 83673 - RNA, 1410 nt, Artificial Sequence; identical to SEQ ID NO: 77746
  derived and/or modified sequence opt1 from neuraminidase__InfluenzaA__AFN17373

SEQ ID NO: 83674 - RNA, 1410 nt, Artificial Sequence; identical to SEQ ID NO: 83379
  derived and/or modified sequence opt1 from neuraminidase__InfluenzaA__AFN17383

SEQ ID NO: 83675 - RNA, 1410 nt, Artificial Sequence; identical to SEQ ID NO: 77746
  derived and/or modified sequence opt1 from neuraminidase__InfluenzaA__AFN17393

SEQ ID NO: 83676 - RNA, 1410 nt, Artificial Sequence; identical to SEQ ID NO: 77746
  derived and/or modified sequence opt1 from neuraminidase__InfluenzaA__AFN17403

SEQ ID NO: 83677 - RNA, 1410 nt, Artificial Sequence; identical to SEQ ID NO: 77746
  derived and/or modified sequence opt1 from neuraminidase__InfluenzaA__AFN17413

SEQ ID NO: 83678 - RNA, 1410 nt, Artificial Sequence; identical to SEQ ID NO: 77746
  derived and/or modified sequence opt1 from neuraminidase__InfluenzaA__AFN17423

SEQ ID NO: 83679 - RNA, 1410 nt, Artificial Sequence; identical to SEQ ID NO: 77746
  derived and/or modified sequence opt1 from neuraminidase__InfluenzaA__AFN17433

SEQ ID NO: 83680 - RNA, 1410 nt, Artificial Sequence; identical to SEQ ID NO: 77746
  derived and/or modified sequence opt1 from neuraminidase__InfluenzaA__AFN17443

SEQ ID NO: 83681 - RNA, 1410 nt, Artificial Sequence; identical to SEQ ID NO: 77746
  derived and/or modified sequence opt1 from neuraminidase__InfluenzaA__AFN17453

SEQ ID NO: 83682 - RNA, 1410 nt, Artificial Sequence; identical to SEQ ID NO: 77746
  derived and/or modified sequence opt1 from neuraminidase__InfluenzaA__AFN17459

SEQ ID NO: 83683 - RNA, 1410 nt, Artificial Sequence; identical to SEQ ID NO: 77746
  derived and/or modified sequence opt1 from neuraminidase__InfluenzaA__AFN17469

SEQ ID NO: 83684 - RNA, 1410 nt, Artificial Sequence; identical to SEQ ID NO: 77746
  derived and/or modified sequence opt1 from neuraminidase__InfluenzaA__AFN17479

SEQ ID NO: 83685 - RNA, 1410 nt, Artificial Sequence; identical to SEQ ID NO: 77746
  derived and/or modified sequence opt1 from neuraminidase__InfluenzaA__AFN17489

SEQ ID NO: 83686 - RNA, 1410 nt, Artificial Sequence; identical to SEQ ID NO: 77746
  derived and/or modified sequence opt1 from neuraminidase__InfluenzaA__AFN17499

SEQ ID NO: 83687 - RNA, 1410 nt, Artificial Sequence; identical to SEQ ID NO: 77746
  derived and/or modified sequence opt1 from neuraminidase__InfluenzaA__AFN17509

SEQ ID NO: 83688 - RNA, 1410 nt, Artificial Sequence; identical to SEQ ID NO: 77746
  derived and/or modified sequence opt1 from neuraminidase__InfluenzaA__AFN17519

SEQ ID NO: 83689 - RNA, 1410 nt, Artificial Sequence; identical to SEQ ID NO: 77746
  derived and/or modified sequence opt1 from neuraminidase__InfluenzaA__AFN17529

SEQ ID NO: 83690 - RNA, 1410 nt, Artificial Sequence; identical to SEQ ID NO: 77746
  derived and/or modified sequence opt1 from neuraminidase__InfluenzaA__AFN17539

SEQ ID NO: 83691 - RNA, 1410 nt, Artificial Sequence; identical to SEQ ID NO: 77746
  derived and/or modified sequence opt1 from neuraminidase__InfluenzaA__AFN17549

SEQ ID NO: 83692 - RNA, 1410 nt, Artificial Sequence; identical to SEQ ID NO: 77746
  derived and/or modified sequence opt1 from neuraminidase__InfluenzaA__AFN17559

SEQ ID NO: 83693 - RNA, 1410 nt, Artificial Sequence; identical to SEQ ID NO: 77746
  derived and/or modified sequence opt1 from neuraminidase__InfluenzaA__AFN17569

SEQ ID NO: 83694 - RNA, 1410 nt, Artificial Sequence; identical to SEQ ID NO: 77746
  derived and/or modified sequence opt1 from neuraminidase__InfluenzaA__AFN17575

SEQ ID NO: 83695 - RNA, 1410 nt, Artificial Sequence; identical to SEQ ID NO: 77746
  derived and/or modified sequence opt1 from neuraminidase__InfluenzaA__AFN17581

SEQ ID NO: 83696 - RNA, 1410 nt, Artificial Sequence; identical to SEQ ID NO: 77746
  derived and/or modified sequence opt1 from neuraminidase__InfluenzaA__AFN17587

SEQ ID NO: 83697 - RNA, 1410 nt, Artificial Sequence; identical to SEQ ID NO: 77746
  derived and/or modified sequence opt1 from neuraminidase__InfluenzaA__AFN17597

SEQ ID NO: 83698 - RNA, 1410 nt, Artificial Sequence; identical to SEQ ID NO: 83379
  derived and/or modified sequence opt1 from neuraminidase__InfluenzaA__AFN17607

SEQ ID NO: 83699 - RNA, 1410 nt, Artificial Sequence; identical to SEQ ID NO: 77746
  derived and/or modified sequence opt1 from neuraminidase__InfluenzaA__AFN17617

SEQ ID NO: 83700 - RNA, 1410 nt, Artificial Sequence; identical to SEQ ID NO: 77746
  derived and/or modified sequence opt1 from neuraminidase__InfluenzaA__AFN17627

SEQ ID NO: 83701 - RNA, 1410 nt, Artificial Sequence; identical to SEQ ID NO: 77746
  derived and/or modified sequence opt1 from neuraminidase__InfluenzaA__AFN17637

SEQ ID NO: 83702 - RNA, 1410 nt, Artificial Sequence; identical to SEQ ID NO: 77746
  derived and/or modified sequence opt1 from neuraminidase__InfluenzaA__AFN17647

SEQ ID NO: 83703 - RNA, 1410 nt, Artificial Sequence; identical to SEQ ID NO: 77746
  derived and/or modified sequence opt1 from neuraminidase__InfluenzaA__AFN17657

SEQ ID NO: 83704 - RNA, 1410 nt, Artificial Sequence; identical to SEQ ID NO: 77746
  derived and/or modified sequence opt1 from neuraminidase__InfluenzaA__AFN17667

SEQ ID NO: 83705 - RNA, 1410 nt, Artificial Sequence; identical to SEQ ID NO: 77746
  derived and/or modified sequence opt1 from neuraminidase__InfluenzaA__AFN17677

SEQ ID NO: 83706 - RNA, 1410 nt, Artificial Sequence; identical to SEQ ID NO: 83379
  derived and/or modified sequence opt1 from neuraminidase__InfluenzaA__AFN17687

SEQ ID NO: 83707 - RNA, 1410 nt, Artificial Sequence; identical to SEQ ID NO: 77746
  derived and/or modified sequence opt1 from neuraminidase__InfluenzaA__AFN17697

SEQ ID NO: 83708 - RNA, 1410 nt, Artificial Sequence; identical to SEQ ID NO: 83379
  derived and/or modified sequence opt1 from neuraminidase__InfluenzaA__AFN17707

SEQ ID NO: 83709 - RNA, 1410 nt, Artificial Sequence; identical to SEQ ID NO: 77746
  derived and/or modified sequence opt1 from neuraminidase__InfluenzaA__AFN17717

SEQ ID NO: 83710 - RNA, 1410 nt, Artificial Sequence; identical to SEQ ID NO: 83379
  derived and/or modified sequence opt1 from neuraminidase__InfluenzaA__AFN17727

SEQ ID NO: 83711 - RNA, 1410 nt, Artificial Sequence; identical to SEQ ID NO: 77746
  derived and/or modified sequence opt1 from neuraminidase__InfluenzaA__AFN17737

SEQ ID NO: 83712 - RNA, 1410 nt, Artificial Sequence; identical to SEQ ID NO: 77746
  derived and/or modified sequence opt1 from neuraminidase__InfluenzaA__AFN17743

SEQ ID NO: 83713 - RNA, 1410 nt, Artificial Sequence; identical to SEQ ID NO: 83379
  derived and/or modified sequence opt1 from neuraminidase__InfluenzaA__AFN17749

SEQ ID NO: 83714 - RNA, 1410 nt, Artificial Sequence; identical to SEQ ID NO: 77746
  derived and/or modified sequence opt1 from neuraminidase__InfluenzaA__AFN17759

SEQ ID NO: 83715 - RNA, 1410 nt, Artificial Sequence; identical to SEQ ID NO: 77746
  derived and/or modified sequence opt1 from neuraminidase__InfluenzaA__AFN17769

SEQ ID NO: 83716 - RNA, 1410 nt, Artificial Sequence; identical to SEQ ID NO: 77746
  derived and/or modified sequence opt1 from neuraminidase__InfluenzaA__AFN17775

SEQ ID NO: 83717 - RNA, 1410 nt, Artificial Sequence
  derived and/or modified sequence opt1 from neuraminidase__InfluenzaA__AFN17785
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacacguucagcaucaagcaggacaucgucgggaucaacgagugguccggcuacagcggguccuucgugcagcacccggagcugaccggccucgacugcauccgccccugcuucuggguggagcugauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 83718 - RNA, 1410 nt, Artificial Sequence
  derived and/or modified sequence opt1 from neuraminidase__InfluenzaA__AFN17795
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucggcggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcagcuucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 83719 - RNA, 1410 nt, Artificial Sequence; identical to SEQ ID NO: 77746
  derived and/or modified sequence opt1 from neuraminidase__InfluenzaA__AFN17805

SEQ ID NO: 83720 - RNA, 1410 nt, Artificial Sequence
  derived and/or modified sequence opt1 from neuraminidase__InfluenzaA__AFN17815
augaaccccaaccagaagaucaucaccaucggcagcguguccaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 83721 - RNA, 1410 nt, Artificial Sequence; identical to SEQ ID NO: 77746
  derived and/or modified sequence opt1 from neuraminidase__InfluenzaA__AFN17825

SEQ ID NO: 83722 - RNA, 1410 nt, Artificial Sequence; identical to SEQ ID NO: 83379
  derived and/or modified sequence opt1 from neuraminidase__InfluenzaA__AFN17835

SEQ ID NO: 83723 - RNA, 1410 nt, Artificial Sequence; identical to SEQ ID NO: 77746
  derived and/or modified sequence opt1 from neuraminidase__InfluenzaA__AFN17845

SEQ ID NO: 83724 - RNA, 1410 nt, Artificial Sequence; identical to SEQ ID NO: 77746
  derived and/or modified sequence opt1 from neuraminidase__InfluenzaA__AFN17855

SEQ ID NO: 83725 - RNA, 1410 nt, Artificial Sequence; identical to SEQ ID NO: 79560
  derived and/or modified sequence opt1 from neuraminidase__InfluenzaA__AFN17865

SEQ ID NO: 83726 - RNA, 1410 nt, Artificial Sequence; identical to SEQ ID NO: 83379
  derived and/or modified sequence opt1 from neuraminidase__InfluenzaA__AFN17875

SEQ ID NO: 83727 - RNA, 1410 nt, Artificial Sequence; identical to SEQ ID NO: 83379
  derived and/or modified sequence opt1 from neuraminidase__InfluenzaA__AFN17885

SEQ ID NO: 83728 - RNA, 1410 nt, Artificial Sequence; identical to SEQ ID NO: 77746
  derived and/or modified sequence opt1 from neuraminidase__InfluenzaA__AFN17895

SEQ ID NO: 83729 - RNA, 1410 nt, Artificial Sequence; identical to SEQ ID NO: 83379
  derived and/or modified sequence opt1 from neuraminidase__InfluenzaA__AFN17905

SEQ ID NO: 83730 - RNA, 1410 nt, Artificial Sequence; identical to SEQ ID NO: 77746
  derived and/or modified sequence opt1 from neuraminidase__InfluenzaA__AFN17911

SEQ ID NO: 83731 - RNA, 1410 nt, Artificial Sequence; identical to SEQ ID NO: 83379
  derived and/or modified sequence opt1 from neuraminidase__InfluenzaA__AFN17921

SEQ ID NO: 83732 - RNA, 1410 nt, Artificial Sequence
  derived and/or modified sequence opt1 from neuraminidase__InfluenzaA__AFN17931
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcucccgcggggacguguucgugauccgggagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccgcaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83733 - RNA, 1410 nt, Artificial Sequence; identical to SEQ ID NO: 77746
  derived and/or modified sequence opt1 from neuraminidase__InfluenzaA__AFN17941

SEQ ID NO: 83734 - RNA, 1410 nt, Artificial Sequence; identical to SEQ ID NO: 77746
  derived and/or modified sequence opt1 from neuraminidase__InfluenzaA__AFN17951

SEQ ID NO: 83735 - RNA, 1410 nt, Artificial Sequence
  derived and/or modified sequence opt1 from neuraminidase__InfluenzaA__AFN17961
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaacuccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83736 - RNA, 1410 nt, Artificial Sequence; identical to SEQ ID NO: 77746
  derived and/or modified sequence opt1 from neuraminidase__InfluenzaA__AFN17971

SEQ ID NO: 83737 - RNA, 1410 nt, Artificial Sequence; identical to SEQ ID NO: 77746
  derived and/or modified sequence opt1 from neuraminidase__InfluenzaA__AFN17981

SEQ ID NO: 83738 - RNA, 1410 nt, Artificial Sequence; identical to SEQ ID NO: 77746
  derived and/or modified sequence opt1 from neuraminidase__InfluenzaA__AFN17991

SEQ ID NO: 83739 - RNA, 1410 nt, Artificial Sequence
  derived and/or modified sequence opt1 from neuraminidase__InfluenzaA__AFN18001
augaaccccaaccagaagaucaucaccaucagcuccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagagcgagugcgcgugcgugaacggcuccugcuucacccucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccuggaguaccagaucggcuacaucugcagcgggaucuucggcgacaacccgcggcccaacgacaagaccggguccugcggccccgucagcuccaacggcgccaacggggugaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgucggcaucaacgaguggagcggguacuccggcagcuucgugcagcacccggagcugacggggcucgacugcauccgccccugcuucuggguggagcugauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 83740 - RNA, 1410 nt, Artificial Sequence; identical to SEQ ID NO: 77746
  derived and/or modified sequence opt1 from neuraminidase__InfluenzaA__AFN18011

SEQ ID NO: 83741 - RNA, 1410 nt, Artificial Sequence; identical to SEQ ID NO: 77746
  derived and/or modified sequence opt1 from neuraminidase__InfluenzaA__AFN18021

SEQ ID NO: 83742 - RNA, 1410 nt, Artificial Sequence
  derived and/or modified sequence opt1 from neuraminidase__InfluenzaA__AFN18031
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucacccucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccucgacugcauccgccccugcuucuggguggagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83743 - RNA, 1410 nt, Artificial Sequence; identical to SEQ ID NO: 77746
  derived and/or modified sequence opt1 from neuraminidase__InfluenzaA__AFN18041

SEQ ID NO: 83744 - RNA, 1410 nt, Artificial Sequence; identical to SEQ ID NO: 83379
  derived and/or modified sequence opt1 from neuraminidase__InfluenzaA__AFN18051

SEQ ID NO: 83745 - RNA, 1410 nt, Artificial Sequence; identical to SEQ ID NO: 83379
  derived and/or modified sequence opt1 from neuraminidase__InfluenzaA__AFN18061

SEQ ID NO: 83746 - RNA, 1410 nt, Artificial Sequence; identical to SEQ ID NO: 77746
  derived and/or modified sequence opt1 from neuraminidase__InfluenzaA__AFN18070

SEQ ID NO: 83747 - RNA, 1410 nt, Artificial Sequence; identical to SEQ ID NO: 77746
  derived and/or modified sequence opt1 from neuraminidase__InfluenzaA__AFN18080

SEQ ID NO: 83748 - RNA, 1410 nt, Artificial Sequence; identical to SEQ ID NO: 77746
  derived and/or modified sequence opt1 from neuraminidase__InfluenzaA__AFN18090

SEQ ID NO: 83749 - RNA, 1410 nt, Artificial Sequence; identical to SEQ ID NO: 77746
  derived and/or modified sequence opt1 from neuraminidase__InfluenzaA__AFN18100

SEQ ID NO: 83750 - RNA, 1410 nt, Artificial Sequence; identical to SEQ ID NO: 77746
  derived and/or modified sequence opt1 from neuraminidase__InfluenzaA__AFN18106

SEQ ID NO: 83751 - RNA, 1410 nt, Artificial Sequence
  derived and/or modified sequence opt1 from neuraminidase__InfluenzaA__AFN18108
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccgugcuguccaacggggccaacggcgugaagggguucagcuucaaguacggcaacggggucuggaucggccggaccaaguccaucagcagccgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccggcccugcuucugggucgagcugauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 83752 - RNA, 1410 nt, Artificial Sequence
  derived and/or modified sequence opt1 from neuraminidase__InfluenzaA__AFN18118
augaaccccaaccagaagaucaucaccaucggcagcgugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaagaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83753 - RNA, 1410 nt, Artificial Sequence; identical to SEQ ID NO: 77746
  derived and/or modified sequence opt1 from neuraminidase__InfluenzaA__AFN18120

SEQ ID NO: 83754 - RNA, 1410 nt, Artificial Sequence; identical to SEQ ID NO: 77746
  derived and/or modified sequence opt1 from neuraminidase__InfluenzaA__AFN18122

SEQ ID NO: 83755 - RNA, 1410 nt, Artificial Sequence; identical to SEQ ID NO: 83379
  derived and/or modified sequence opt1 from neuraminidase__InfluenzaA__AFN18128

SEQ ID NO: 83756 - RNA, 1410 nt, Artificial Sequence; identical to SEQ ID NO: 83379
  derived and/or modified sequence opt1 from neuraminidase__InfluenzaA__AFN18134

SEQ ID NO: 83757 - RNA, 1410 nt, Artificial Sequence; identical to SEQ ID NO: 77746
  derived and/or modified sequence opt1 from neuraminidase__InfluenzaA__AFN18136

SEQ ID NO: 83758 - RNA, 1410 nt, Artificial Sequence; identical to SEQ ID NO: 77746
  derived and/or modified sequence opt1 from neuraminidase__InfluenzaA__AFN18138

SEQ ID NO: 83759 - RNA, 1410 nt, Artificial Sequence
  derived and/or modified sequence opt1 from neuraminidase__InfluenzaA__AFN18140
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacgggaucuggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 83760 - RNA, 1410 nt, Artificial Sequence; identical to SEQ ID NO: 77746
  derived and/or modified sequence opt1 from neuraminidase__InfluenzaA__AFN18144

SEQ ID NO: 83761 - RNA, 1410 nt, Artificial Sequence; identical to SEQ ID NO: 77746
  derived and/or modified sequence opt1 from neuraminidase__InfluenzaA__AFN18150

SEQ ID NO: 83762 - RNA, 1410 nt, Artificial Sequence; identical to SEQ ID NO: 77746
  derived and/or modified sequence opt1 from neuraminidase__InfluenzaA__AFN18156

SEQ ID NO: 83763 - RNA, 1410 nt, Artificial Sequence; identical to SEQ ID NO: 77746
  derived and/or modified sequence opt1 from neuraminidase__InfluenzaA__AFN18158

SEQ ID NO: 83764 - RNA, 1410 nt, Artificial Sequence; identical to SEQ ID NO: 79560
  derived and/or modified sequence opt1 from neuraminidase__InfluenzaA__AFN18160

SEQ ID NO: 83765 - RNA, 1410 nt, Artificial Sequence
  derived and/or modified sequence opt1 from neuraminidase__InfluenzaA__AFN18166
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacgccaacuucgcggccggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagcaaguucgagagcguggcgugguccgccagcgccugccacgacgggaucaacuggcucacgaucggcaucuccggccccgacaacggggccguggcgguccugaaguacaacggcaucaucaccgacaccaucaagagcuggcggaacaacauccugcgcacccaggaguccgagugcgccugcgugaacgggagcugcuucacggugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgcggagcugccguucaccaucgacaaguga

SEQ ID NO: 83766 - RNA, 1410 nt, Artificial Sequence; identical to SEQ ID NO: 77746
  derived and/or modified sequence opt1 from neuraminidase__InfluenzaA__AFN18172

SEQ ID NO: 83767 - RNA, 1410 nt, Artificial Sequence; identical to SEQ ID NO: 78764
  derived and/or modified sequence opt1 from neuraminidase__InfluenzaA__AFN18178

SEQ ID NO: 83768 - RNA, 1410 nt, Artificial Sequence
  derived and/or modified sequence opt1 from neuraminidase__InfluenzaA__AFN18184
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83769 - RNA, 1410 nt, Artificial Sequence; identical to SEQ ID NO: 80738
  derived and/or modified sequence opt1 from neuraminidase__InfluenzaA__AFN18190

SEQ ID NO: 83770 - RNA, 1410 nt, Artificial Sequence; identical to SEQ ID NO: 81759
  derived and/or modified sequence opt1 from neuraminidase__InfluenzaA__AFN18196

SEQ ID NO: 83771 - RNA, 1410 nt, Artificial Sequence
  derived and/or modified sequence opt1 from neuraminidase__InfluenzaA__AFN18202
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccgcagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 83772 - RNA, 1410 nt, Artificial Sequence; identical to SEQ ID NO: 77746
  derived and/or modified sequence opt1 from neuraminidase__InfluenzaA__AFN18208

SEQ ID NO: 83773 - RNA, 1410 nt, Artificial Sequence
  derived and/or modified sequence opt1 from neuraminidase__InfluenzaA__AFN18210
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcgccuucuuccugacccagggcgcccuccugaacgacaagcacuccaacgggaccaucaaggaccggucccccuaccgcacccugaugagcugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcugaaggagaacacgaucuggaccagcggguccagcaucuccuucugcggcgugaacagcgacaccgucgggugguccuggcccgacggcgcggagcugcccuucaccaucgacaaguga

SEQ ID NO: 83774 - RNA, 1410 nt, Artificial Sequence; identical to SEQ ID NO: 78329
  derived and/or modified sequence opt1 from neuraminidase__InfluenzaA__AFN18216

SEQ ID NO: 83775 - RNA, 1410 nt, Artificial Sequence; identical to SEQ ID NO: 80075
  derived and/or modified sequence opt1 from neuraminidase__InfluenzaA__AFN18226

SEQ ID NO: 83776 - RNA, 1410 nt, Artificial Sequence; identical to SEQ ID NO: 77746
  derived and/or modified sequence opt1 from neuraminidase__InfluenzaA__AFN18232

SEQ ID NO: 83777 - RNA, 1410 nt, Artificial Sequence; identical to SEQ ID NO: 77746
  derived and/or modified sequence opt1 from neuraminidase__InfluenzaA__AFN18234

SEQ ID NO: 83778 - RNA, 1410 nt, Artificial Sequence; identical to SEQ ID NO: 77746
  derived and/or modified sequence opt1 from neuraminidase__InfluenzaA__AFN18244

SEQ ID NO: 83779 - RNA, 1410 nt, Artificial Sequence; identical to SEQ ID NO: 77746
  derived and/or modified sequence opt1 from neuraminidase__InfluenzaA__AFN18246

SEQ ID NO: 83780 - RNA, 1410 nt, Artificial Sequence; identical to SEQ ID NO: 80075
  derived and/or modified sequence opt1 from neuraminidase__InfluenzaA__AFN18256

SEQ ID NO: 83781 - RNA, 1410 nt, Artificial Sequence; identical to SEQ ID NO: 77746
  derived and/or modified sequence opt1 from neuraminidase__InfluenzaA__AFN18262

SEQ ID NO: 83782 - RNA, 1410 nt, Artificial Sequence; identical to SEQ ID NO: 77746
  derived and/or modified sequence opt1 from neuraminidase__InfluenzaA__AFN18268

SEQ ID NO: 83783 - RNA, 1410 nt, Artificial Sequence; identical to SEQ ID NO: 77746
  derived and/or modified sequence opt1 from neuraminidase__InfluenzaA__AFN18270

SEQ ID NO: 83784 - RNA, 1410 nt, Artificial Sequence; identical to SEQ ID NO: 80735
  derived and/or modified sequence opt1 from neuraminidase__InfluenzaA__AFN18272

SEQ ID NO: 83785 - RNA, 1410 nt, Artificial Sequence; identical to SEQ ID NO: 77746
  derived and/or modified sequence opt1 from neuraminidase__InfluenzaA__AFN18274

SEQ ID NO: 83786 - RNA, 1410 nt, Artificial Sequence; identical to SEQ ID NO: 77746
  derived and/or modified sequence opt1 from neuraminidase__InfluenzaA__AFN18282

SEQ ID NO: 83787 - RNA, 1410 nt, Artificial Sequence; identical to SEQ ID NO: 77746
  derived and/or modified sequence opt1 from neuraminidase__InfluenzaA__AFN18304

SEQ ID NO: 83788 - RNA, 1410 nt, Artificial Sequence
  derived and/or modified sequence opt1 from neuraminidase__InfluenzaA__AFN18306
augaaccccaaccagaagaucaucaccaucggcagcgugugcaugaccaucgggaucgccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83789 - RNA, 1410 nt, Artificial Sequence
  derived and/or modified sequence opt1 from neuraminidase__InfluenzaA__AFN18308
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaagggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83790 - RNA, 1410 nt, Artificial Sequence
  derived and/or modified sequence opt1 from neuraminidase__InfluenzaA__AFN18314
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaagaccaucuggaccagcggguccagcaucuccuucugcggcgugaacagcgacaccgucgggugguccuggcccgacggcgccgagcugccguucacgaucgacaaguga

SEQ ID NO: 83791 - RNA, 1410 nt, Artificial Sequence; identical to SEQ ID NO: 77746
  derived and/or modified sequence opt1 from neuraminidase__InfluenzaA__AFN18320

SEQ ID NO: 83792 - RNA, 1410 nt, Artificial Sequence
  derived and/or modified sequence opt1 from neuraminidase__InfluenzaA__AFN18326
augaaccccaaccagaagaucaucaccaucggcagcgugugcaugaccaucgggauggccaaccugcuccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83793 - RNA, 1410 nt, Artificial Sequence; identical to SEQ ID NO: 77746
  derived and/or modified sequence opt1 from neuraminidase__InfluenzaA__AFN18336

SEQ ID NO: 83794 - RNA, 1410 nt, Artificial Sequence; identical to SEQ ID NO: 77746
  derived and/or modified sequence opt1 from neuraminidase__InfluenzaA__AFN18346

SEQ ID NO: 83795 - RNA, 1410 nt, Artificial Sequence; identical to SEQ ID NO: 83379
  derived and/or modified sequence opt1 from neuraminidase__InfluenzaA__AFN18356

SEQ ID NO: 83796 - RNA, 1410 nt, Artificial Sequence
  derived and/or modified sequence opt1 from neuraminidase__InfluenzaA__AFN18366
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgaggugaccugcgucugccgggacaacuggcacggguccaaccgccccugggugagcuucaaccagaaccucgaguaccagaucggcuacaucugcuccgggaucuucggcgacaacccgcggcccaacgacaagacggggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 83797 - RNA, 1410 nt, Artificial Sequence; identical to SEQ ID NO: 83379
  derived and/or modified sequence opt1 from neuraminidase__InfluenzaA__AFN18376

SEQ ID NO: 83798 - RNA, 1410 nt, Artificial Sequence; identical to SEQ ID NO: 77746
  derived and/or modified sequence opt1 from neuraminidase__InfluenzaA__AFN18382

SEQ ID NO: 83799 - RNA, 1410 nt, Artificial Sequence; identical to SEQ ID NO: 77746
  derived and/or modified sequence opt1 from neuraminidase__InfluenzaA__AFN18392

SEQ ID NO: 83800 - RNA, 1410 nt, Artificial Sequence; identical to SEQ ID NO: 77746
  derived and/or modified sequence opt1 from neuraminidase__InfluenzaA__AFN18402

SEQ ID NO: 83801 - RNA, 1410 nt, Artificial Sequence; identical to SEQ ID NO: 77746
  derived and/or modified sequence opt1 from neuraminidase__InfluenzaA__AFN18412

SEQ ID NO: 83802 - RNA, 1410 nt, Artificial Sequence; identical to SEQ ID NO: 77746
  derived and/or modified sequence opt1 from neuraminidase__InfluenzaA__AFN18422

SEQ ID NO: 83803 - RNA, 1410 nt, Artificial Sequence; identical to SEQ ID NO: 77746
  derived and/or modified sequence opt1 from neuraminidase__InfluenzaA__AFN18432

SEQ ID NO: 83804 - RNA, 1410 nt, Artificial Sequence; identical to SEQ ID NO: 77746
  derived and/or modified sequence opt1 from neuraminidase__InfluenzaA__AFN18442

SEQ ID NO: 83805 - RNA, 1410 nt, Artificial Sequence; identical to SEQ ID NO: 77746
  derived and/or modified sequence opt1 from neuraminidase__InfluenzaA__AFN18452

SEQ ID NO: 83806 - RNA, 1410 nt, Artificial Sequence; identical to SEQ ID NO: 77746
  derived and/or modified sequence opt1 from neuraminidase__InfluenzaA__AFN18462

SEQ ID NO: 83807 - RNA, 1410 nt, Artificial Sequence
  derived and/or modified sequence opt1 from neuraminidase__InfluenzaA__AFN18472
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaagggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83808 - RNA, 1410 nt, Artificial Sequence; identical to SEQ ID NO: 77746
  derived and/or modified sequence opt1 from neuraminidase__InfluenzaA__AFN18482

SEQ ID NO: 83809 - RNA, 1410 nt, Artificial Sequence; identical to SEQ ID NO: 77746
  derived and/or modified sequence opt1 from neuraminidase__InfluenzaA__AFN18492

SEQ ID NO: 83810 - RNA, 1410 nt, Artificial Sequence
  derived and/or modified sequence opt1 from neuraminidase__InfluenzaA__AFN18514
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83811 - RNA, 1410 nt, Artificial Sequence
  derived and/or modified sequence opt1 from neuraminidase__InfluenzaA__AFN18520
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83812 - RNA, 1410 nt, Artificial Sequence; identical to SEQ ID NO: 77746
  derived and/or modified sequence opt1 from neuraminidase__InfluenzaA__AFN18522

SEQ ID NO: 83813 - RNA, 1410 nt, Artificial Sequence; identical to SEQ ID NO: 77746
  derived and/or modified sequence opt1 from neuraminidase__InfluenzaA__AFN18524

SEQ ID NO: 83814 - RNA, 1410 nt, Artificial Sequence; identical to SEQ ID NO: 83379
  derived and/or modified sequence opt1 from neuraminidase__InfluenzaA__AFN18530

SEQ ID NO: 83815 - RNA, 1410 nt, Artificial Sequence; identical to SEQ ID NO: 77746
  derived and/or modified sequence opt1 from neuraminidase__InfluenzaA__AFN18532

SEQ ID NO: 83816 - RNA, 1410 nt, Artificial Sequence; identical to SEQ ID NO: 77746
  derived and/or modified sequence opt1 from neuraminidase__InfluenzaA__AFN18538

SEQ ID NO: 83817 - RNA, 1410 nt, Artificial Sequence; identical to SEQ ID NO: 77746
  derived and/or modified sequence opt1 from neuraminidase__InfluenzaA__AFN18544

SEQ ID NO: 83818 - RNA, 1410 nt, Artificial Sequence; identical to SEQ ID NO: 77746
  derived and/or modified sequence opt1 from neuraminidase__InfluenzaA__AFN18546

SEQ ID NO: 83819 - RNA, 1410 nt, Artificial Sequence; identical to SEQ ID NO: 77746
  derived and/or modified sequence opt1 from neuraminidase__InfluenzaA__AFN18552

SEQ ID NO: 83820 - RNA, 1410 nt, Artificial Sequence; identical to SEQ ID NO: 77746
  derived and/or modified sequence opt1 from neuraminidase__InfluenzaA__AFN18558

SEQ ID NO: 83821 - RNA, 1410 nt, Artificial Sequence; identical to SEQ ID NO: 77746
  derived and/or modified sequence opt1 from neuraminidase__InfluenzaA__AFN18560

SEQ ID NO: 83822 - RNA, 1410 nt, Artificial Sequence; identical to SEQ ID NO: 77746
  derived and/or modified sequence opt1 from neuraminidase__InfluenzaA__AFN18562

SEQ ID NO: 83823 - RNA, 1410 nt, Artificial Sequence; identical to SEQ ID NO: 77746
  derived and/or modified sequence opt1 from neuraminidase__InfluenzaA__AFN18564

SEQ ID NO: 83824 - RNA, 1410 nt, Artificial Sequence; identical to SEQ ID NO: 77746
  derived and/or modified sequence opt1 from neuraminidase__InfluenzaA__AFN18566

SEQ ID NO: 83825 - RNA, 1410 nt, Artificial Sequence; identical to SEQ ID NO: 77746
  derived and/or modified sequence opt1 from neuraminidase__InfluenzaA__AFN18572

SEQ ID NO: 83826 - RNA, 1410 nt, Artificial Sequence; identical to SEQ ID NO: 77746
  derived and/or modified sequence opt1 from neuraminidase__InfluenzaA__AFN18582

SEQ ID NO: 83827 - RNA, 1410 nt, Artificial Sequence; identical to SEQ ID NO: 77746
  derived and/or modified sequence opt1 from neuraminidase__InfluenzaA__AFN18592

SEQ ID NO: 83828 - RNA, 1410 nt, Artificial Sequence; identical to SEQ ID NO: 83379
  derived and/or modified sequence opt1 from neuraminidase__InfluenzaA__AFN18602

SEQ ID NO: 83829 - RNA, 1410 nt, Artificial Sequence
  derived and/or modified sequence opt1 from neuraminidase__InfluenzaA__AFN18612
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83830 - RNA, 1410 nt, Artificial Sequence; identical to SEQ ID NO: 77746
  derived and/or modified sequence opt1 from neuraminidase__InfluenzaA__AFN18618

SEQ ID NO: 83831 - RNA, 1410 nt, Artificial Sequence; identical to SEQ ID NO: 78572
  derived and/or modified sequence opt1 from neuraminidase__InfluenzaA__AFN18624

SEQ ID NO: 83832 - RNA, 1410 nt, Artificial Sequence
  derived and/or modified sequence opt1 from neuraminidase__InfluenzaA__AFN18630
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccugggcugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 83833 - RNA, 1410 nt, Artificial Sequence
  derived and/or modified sequence opt1 from neuraminidase__InfluenzaA__AFN18636
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggagcaaggagaacaccaucuggaccuccgggagcuccaucagcuucugcggcgugaacuccgacaccgucggguggagcuggcccgacggcgccgagcugcccuucacgaucgacaaguga

SEQ ID NO: 83834 - RNA, 1410 nt, Artificial Sequence; identical to SEQ ID NO: 77746
  derived and/or modified sequence opt1 from neuraminidase__InfluenzaA__AFN18646

SEQ ID NO: 83835 - RNA, 1410 nt, Artificial Sequence; identical to SEQ ID NO: 77746
  derived and/or modified sequence opt1 from neuraminidase__InfluenzaA__AFN18656

SEQ ID NO: 83836 - RNA, 1410 nt, Artificial Sequence
  derived and/or modified sequence opt1 from neuraminidase__InfluenzaA__AFN18666
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 83837 - RNA, 1410 nt, Artificial Sequence
  derived and/or modified sequence opt1 from neuraminidase__InfluenzaA__AFN18676
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccgagaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 83838 - RNA, 1410 nt, Artificial Sequence
  derived and/or modified sequence opt1 from neuraminidase__InfluenzaA__AFN18686
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccagcacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucacccucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 83839 - RNA, 1410 nt, Artificial Sequence; identical to SEQ ID NO: 77746
  derived and/or modified sequence opt1 from neuraminidase__InfluenzaA__AFN18696

SEQ ID NO: 83840 - RNA, 1410 nt, Artificial Sequence; identical to SEQ ID NO: 80333
  derived and/or modified sequence opt1 from neuraminidase__InfluenzaA__AFN18706

SEQ ID NO: 83841 - RNA, 1410 nt, Artificial Sequence; identical to SEQ ID NO: 77746
  derived and/or modified sequence opt1 from neuraminidase__InfluenzaA__AFN18716

SEQ ID NO: 83842 - RNA, 1410 nt, Artificial Sequence; identical to SEQ ID NO: 77746
  derived and/or modified sequence opt1 from neuraminidase__InfluenzaA__AFN18727

SEQ ID NO: 83843 - RNA, 1410 nt, Artificial Sequence
  derived and/or modified sequence opt1 from neuraminidase__InfluenzaA__AFN18737
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagauggugugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 83844 - RNA, 1410 nt, Artificial Sequence; identical to SEQ ID NO: 77746
  derived and/or modified sequence opt1 from neuraminidase__InfluenzaA__AFN18743

SEQ ID NO: 83845 - RNA, 1410 nt, Artificial Sequence; identical to SEQ ID NO: 77746
  derived and/or modified sequence opt1 from neuraminidase__InfluenzaA__AFN18749

SEQ ID NO: 83846 - RNA, 1410 nt, Artificial Sequence; identical to SEQ ID NO: 77746
  derived and/or modified sequence opt1 from neuraminidase__InfluenzaA__AFN18759

SEQ ID NO: 83847 - RNA, 1410 nt, Artificial Sequence
  derived and/or modified sequence opt1 from neuraminidase__InfluenzaA__AFN18769
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccaacgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 83848 - RNA, 1410 nt, Artificial Sequence; identical to SEQ ID NO: 79648
  derived and/or modified sequence opt1 from neuraminidase__InfluenzaA__AFN18775

SEQ ID NO: 83849 - RNA, 1410 nt, Artificial Sequence; identical to SEQ ID NO: 77746
  derived and/or modified sequence opt1 from neuraminidase__InfluenzaA__AFN18777

SEQ ID NO: 83850 - RNA, 1410 nt, Artificial Sequence; identical to SEQ ID NO: 77746
  derived and/or modified sequence opt1 from neuraminidase__InfluenzaA__AFN18779

SEQ ID NO: 83851 - RNA, 1410 nt, Artificial Sequence
  derived and/or modified sequence opt1 from neuraminidase__InfluenzaA__AFN18785
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcauccgccaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 83852 - RNA, 1410 nt, Artificial Sequence
  derived and/or modified sequence opt1 from neuraminidase__InfluenzaA__AFN18791
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgaguccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83853 - RNA, 1410 nt, Artificial Sequence; identical to SEQ ID NO: 77746
  derived and/or modified sequence opt1 from neuraminidase__InfluenzaA__AFN18801

SEQ ID NO: 83854 - RNA, 1410 nt, Artificial Sequence; identical to SEQ ID NO: 80165
  derived and/or modified sequence opt1 from neuraminidase__InfluenzaA__AFN18811

SEQ ID NO: 83855 - RNA, 1410 nt, Artificial Sequence; identical to SEQ ID NO: 77746
  derived and/or modified sequence opt1 from neuraminidase__InfluenzaA__AFN18817

SEQ ID NO: 83856 - RNA, 1410 nt, Artificial Sequence; identical to SEQ ID NO: 77746
  derived and/or modified sequence opt1 from neuraminidase__InfluenzaA__AFN18819

SEQ ID NO: 83857 - RNA, 1410 nt, Artificial Sequence; identical to SEQ ID NO: 80738
  derived and/or modified sequence opt1 from neuraminidase__InfluenzaA__AFN18821

SEQ ID NO: 83858 - RNA, 1410 nt, Artificial Sequence; identical to SEQ ID NO: 77746
  derived and/or modified sequence opt1 from neuraminidase__InfluenzaA__AFN18823

SEQ ID NO: 83859 - RNA, 1410 nt, Artificial Sequence; identical to SEQ ID NO: 77746
  derived and/or modified sequence opt1 from neuraminidase__InfluenzaA__AFN18825

SEQ ID NO: 83860 - RNA, 1410 nt, Artificial Sequence; identical to SEQ ID NO: 77746
  derived and/or modified sequence opt1 from neuraminidase__InfluenzaA__AFN18827

SEQ ID NO: 83861 - RNA, 1410 nt, Artificial Sequence; identical to SEQ ID NO: 77746
  derived and/or modified sequence opt1 from neuraminidase__InfluenzaA__AFN18829

SEQ ID NO: 83862 - RNA, 1410 nt, Artificial Sequence; identical to SEQ ID NO: 77746
  derived and/or modified sequence opt1 from neuraminidase__InfluenzaA__AFN18831

SEQ ID NO: 83863 - RNA, 1410 nt, Artificial Sequence; identical to SEQ ID NO: 78883
  derived and/or modified sequence opt1 from neuraminidase__InfluenzaA__AFN18833

SEQ ID NO: 83864 - RNA, 1410 nt, Artificial Sequence; identical to SEQ ID NO: 78921
  derived and/or modified sequence opt1 from neuraminidase__InfluenzaA__AFN18835

SEQ ID NO: 83865 - RNA, 1410 nt, Artificial Sequence; identical to SEQ ID NO: 77746
  derived and/or modified sequence opt1 from neuraminidase__InfluenzaA__AFN18841

SEQ ID NO: 83866 - RNA, 1410 nt, Artificial Sequence
  derived and/or modified sequence opt1 from neuraminidase__InfluenzaA__AFN18851
augaaccccaaccagaagaucaucaccaucggcagcgugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83867 - RNA, 1410 nt, Artificial Sequence; identical to SEQ ID NO: 77746
  derived and/or modified sequence opt1 from neuraminidase__InfluenzaA__AFN18857

SEQ ID NO: 83868 - RNA, 1410 nt, Artificial Sequence
  derived and/or modified sequence opt1 from neuraminidase__InfluenzaA__AFN18859
augaaccccaaccagaagaucaucaccaucggcagcgugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83869 - RNA, 1410 nt, Artificial Sequence
  derived and/or modified sequence opt1 from neuraminidase__InfluenzaA__AFN18861
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcagcgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggagccccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 83870 - RNA, 1410 nt, Artificial Sequence; identical to SEQ ID NO: 77746
  derived and/or modified sequence opt1 from neuraminidase__InfluenzaA__AFN18867

SEQ ID NO: 83871 - RNA, 1410 nt, Artificial Sequence; identical to SEQ ID NO: 79560
  derived and/or modified sequence opt1 from neuraminidase__InfluenzaA__AFN18877

SEQ ID NO: 83872 - RNA, 1410 nt, Artificial Sequence; identical to SEQ ID NO: 77746
  derived and/or modified sequence opt1 from neuraminidase__InfluenzaA__AFN18887

SEQ ID NO: 83873 - RNA, 1410 nt, Artificial Sequence; identical to SEQ ID NO: 78764
  derived and/or modified sequence opt1 from neuraminidase__InfluenzaA__AFN18893

SEQ ID NO: 83874 - RNA, 1410 nt, Artificial Sequence
  derived and/or modified sequence opt1 from neuraminidase__InfluenzaA__AFN18895
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucaucaagggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83875 - RNA, 1410 nt, Artificial Sequence; identical to SEQ ID NO: 79648
  derived and/or modified sequence opt1 from neuraminidase__InfluenzaA__AFN18905

SEQ ID NO: 83876 - RNA, 1410 nt, Artificial Sequence; identical to SEQ ID NO: 79560
  derived and/or modified sequence opt1 from neuraminidase__InfluenzaA__AFN18913

SEQ ID NO: 83877 - RNA, 1410 nt, Artificial Sequence
  derived and/or modified sequence opt1 from neuraminidase__InfluenzaA__AFN18919
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggagaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83878 - RNA, 1410 nt, Artificial Sequence
  derived and/or modified sequence opt1 from neuraminidase__InfluenzaA__AFN18929
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggagcgacggcgccgagcugcccuucacgaucgacaaguga

SEQ ID NO: 83879 - RNA, 1410 nt, Artificial Sequence; identical to SEQ ID NO: 77746
  derived and/or modified sequence opt1 from neuraminidase__InfluenzaA__AFN18939

SEQ ID NO: 83880 - RNA, 1410 nt, Artificial Sequence; identical to SEQ ID NO: 77746
  derived and/or modified sequence opt1 from neuraminidase__InfluenzaA__AFN18953

SEQ ID NO: 83881 - RNA, 1410 nt, Artificial Sequence; identical to SEQ ID NO: 77746
  derived and/or modified sequence opt1 from neuraminidase__InfluenzaA__AFN18959

SEQ ID NO: 83882 - RNA, 1410 nt, Artificial Sequence; identical to SEQ ID NO: 77746
  derived and/or modified sequence opt1 from neuraminidase__InfluenzaA__AFN18965

SEQ ID NO: 83883 - RNA, 1410 nt, Artificial Sequence; identical to SEQ ID NO: 81816
  derived and/or modified sequence opt1 from neuraminidase__InfluenzaA__AFN18975

SEQ ID NO: 83884 - RNA, 1410 nt, Artificial Sequence; identical to SEQ ID NO: 77746
  derived and/or modified sequence opt1 from neuraminidase__InfluenzaA__AFN18981

SEQ ID NO: 83885 - RNA, 1410 nt, Artificial Sequence
  derived and/or modified sequence opt1 from neuraminidase__InfluenzaA__AFN18983
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgccagcaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcaccccgagcugacgggccuggacugcauccgcccgugcuucugggucgagcucauccggggccgccccaaggagaacaccaucuggaccuccgggagcaucaucuccuucugcggcgugaacagcgacaccgucgggugguccuggcccgacggcgccgagcugcccuucacgaucgacaaguga

SEQ ID NO: 83886 - RNA, 1410 nt, Artificial Sequence; identical to SEQ ID NO: 77746
  derived and/or modified sequence opt1 from neuraminidase__InfluenzaA__AFN18985

SEQ ID NO: 83887 - RNA, 1410 nt, Artificial Sequence
  derived and/or modified sequence opt1 from neuraminidase__InfluenzaA__AFN18987
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaucgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83888 - RNA, 1410 nt, Artificial Sequence; identical to SEQ ID NO: 77746
  derived and/or modified sequence opt1 from neuraminidase__InfluenzaA__AFN18989

SEQ ID NO: 83889 - RNA, 1410 nt, Artificial Sequence; identical to SEQ ID NO: 77746
  derived and/or modified sequence opt1 from neuraminidase__InfluenzaA__AFN18995

SEQ ID NO: 83890 - RNA, 1410 nt, Artificial Sequence; identical to SEQ ID NO: 83868
  derived and/or modified sequence opt1 from neuraminidase__InfluenzaA__AFN19001

SEQ ID NO: 83891 - RNA, 1410 nt, Artificial Sequence; identical to SEQ ID NO: 77746
  derived and/or modified sequence opt1 from neuraminidase__InfluenzaA__AFN19007

SEQ ID NO: 83892 - RNA, 1410 nt, Artificial Sequence; identical to SEQ ID NO: 77746
  derived and/or modified sequence opt1 from neuraminidase__InfluenzaA__AFN19024

SEQ ID NO: 83893 - RNA, 1410 nt, Artificial Sequence
  derived and/or modified sequence opt1 from neuraminidase__InfluenzaA__AFN19025
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaagauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 83894 - RNA, 1410 nt, Artificial Sequence; identical to SEQ ID NO: 77746
  derived and/or modified sequence opt1 from neuraminidase__InfluenzaA__AFN19027

SEQ ID NO: 83895 - RNA, 1410 nt, Artificial Sequence; identical to SEQ ID NO: 77746
  derived and/or modified sequence opt1 from neuraminidase__InfluenzaA__AFN19032

SEQ ID NO: 83896 - RNA, 1410 nt, Artificial Sequence; identical to SEQ ID NO: 77746
  derived and/or modified sequence opt1 from neuraminidase__InfluenzaA__AFN19038

SEQ ID NO: 83897 - RNA, 1410 nt, Artificial Sequence; identical to SEQ ID NO: 83379
  derived and/or modified sequence opt1 from neuraminidase__InfluenzaA__AFN19049

SEQ ID NO: 83898 - RNA, 1410 nt, Artificial Sequence; identical to SEQ ID NO: 77746
  derived and/or modified sequence opt1 from neuraminidase__InfluenzaA__AFN19055

SEQ ID NO: 83899 - RNA, 1410 nt, Artificial Sequence; identical to SEQ ID NO: 77746
  derived and/or modified sequence opt1 from neuraminidase__InfluenzaA__AFN19065

SEQ ID NO: 83900 - RNA, 1410 nt, Artificial Sequence; identical to SEQ ID NO: 77746
  derived and/or modified sequence opt1 from neuraminidase__InfluenzaA__AFN19071

SEQ ID NO: 83901 - RNA, 1410 nt, Artificial Sequence; identical to SEQ ID NO: 77746
  derived and/or modified sequence opt1 from neuraminidase__InfluenzaA__AFN19077

SEQ ID NO: 83902 - RNA, 1410 nt, Artificial Sequence; identical to SEQ ID NO: 77746
  derived and/or modified sequence opt1 from neuraminidase__InfluenzaA__AFN19083

SEQ ID NO: 83903 - RNA, 1410 nt, Artificial Sequence; identical to SEQ ID NO: 77746
  derived and/or modified sequence opt1 from neuraminidase__InfluenzaA__AFN19089

SEQ ID NO: 83904 - RNA, 1410 nt, Artificial Sequence; identical to SEQ ID NO: 77746
  derived and/or modified sequence opt1 from neuraminidase__InfluenzaA__AFN19099

SEQ ID NO: 83905 - RNA, 1410 nt, Artificial Sequence; identical to SEQ ID NO: 77746
  derived and/or modified sequence opt1 from neuraminidase__InfluenzaA__AFN19105

SEQ ID NO: 83906 - RNA, 1410 nt, Artificial Sequence; identical to SEQ ID NO: 77746
  derived and/or modified sequence opt1 from neuraminidase__InfluenzaA__AFN19114

SEQ ID NO: 83907 - RNA, 1410 nt, Artificial Sequence; identical to SEQ ID NO: 77746
  derived and/or modified sequence opt1 from neuraminidase__InfluenzaA__AFN19126

SEQ ID NO: 83908 - RNA, 1410 nt, Artificial Sequence; identical to SEQ ID NO: 77746
  derived and/or modified sequence opt1 from neuraminidase__InfluenzaA__AFN19136

SEQ ID NO: 83909 - RNA, 1410 nt, Artificial Sequence; identical to SEQ ID NO: 77746
  derived and/or modified sequence opt1 from neuraminidase__InfluenzaA__AFN19146

SEQ ID NO: 83910 - RNA, 1410 nt, Artificial Sequence; identical to SEQ ID NO: 77746
  derived and/or modified sequence opt1 from neuraminidase__InfluenzaA__AFN19156

SEQ ID NO: 83911 - RNA, 1410 nt, Artificial Sequence; identical to SEQ ID NO: 77746
  derived and/or modified sequence opt1 from neuraminidase__InfluenzaA__AFN19166

SEQ ID NO: 83912 - RNA, 1410 nt, Artificial Sequence; identical to SEQ ID NO: 77746
  derived and/or modified sequence opt1 from neuraminidase__InfluenzaA__AFN19186

SEQ ID NO: 83913 - RNA, 1410 nt, Artificial Sequence; identical to SEQ ID NO: 83379
  derived and/or modified sequence opt1 from neuraminidase__InfluenzaA__AFN19196

SEQ ID NO: 83914 - RNA, 1410 nt, Artificial Sequence; identical to SEQ ID NO: 77746
  derived and/or modified sequence opt1 from neuraminidase__InfluenzaA__AFN19205

SEQ ID NO: 83915 - RNA, 1410 nt, Artificial Sequence; identical to SEQ ID NO: 77746
  derived and/or modified sequence opt1 from neuraminidase__InfluenzaA__AFN19215

SEQ ID NO: 83916 - RNA, 1410 nt, Artificial Sequence; identical to SEQ ID NO: 77746
  derived and/or modified sequence opt1 from neuraminidase__InfluenzaA__AFN19225

SEQ ID NO: 83917 - RNA, 1410 nt, Artificial Sequence; identical to SEQ ID NO: 77746
  derived and/or modified sequence opt1 from neuraminidase__InfluenzaA__AFN19235

SEQ ID NO: 83918 - RNA, 1410 nt, Artificial Sequence; identical to SEQ ID NO: 77746
  derived and/or modified sequence opt1 from neuraminidase__InfluenzaA__AFN19245

SEQ ID NO: 83919 - RNA, 1410 nt, Artificial Sequence; identical to SEQ ID NO: 77746
  derived and/or modified sequence opt1 from neuraminidase__InfluenzaA__AFN19251

SEQ ID NO: 83920 - RNA, 1410 nt, Artificial Sequence; identical to SEQ ID NO: 77746
  derived and/or modified sequence opt1 from neuraminidase__InfluenzaA__AFN19261

SEQ ID NO: 83921 - RNA, 1410 nt, Artificial Sequence; identical to SEQ ID NO: 83379
  derived and/or modified sequence opt1 from neuraminidase__InfluenzaA__AFN19271

SEQ ID NO: 83922 - RNA, 1410 nt, Artificial Sequence; identical to SEQ ID NO: 79477
  derived and/or modified sequence opt1 from neuraminidase__InfluenzaA__AFN19281

SEQ ID NO: 83923 - RNA, 1410 nt, Artificial Sequence
  derived and/or modified sequence opt1 from neuraminidase__InfluenzaA__AFN19287
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccuguccgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 83924 - RNA, 1410 nt, Artificial Sequence; identical to SEQ ID NO: 77746
  derived and/or modified sequence opt1 from neuraminidase__InfluenzaA__AFN19297

SEQ ID NO: 83925 - RNA, 1410 nt, Artificial Sequence; identical to SEQ ID NO: 77746
  derived and/or modified sequence opt1 from neuraminidase__InfluenzaA__AFN19307

SEQ ID NO: 83926 - RNA, 1410 nt, Artificial Sequence; identical to SEQ ID NO: 77746
  derived and/or modified sequence opt1 from neuraminidase__InfluenzaA__AFN19317

SEQ ID NO: 83927 - RNA, 1410 nt, Artificial Sequence; identical to SEQ ID NO: 83379
  derived and/or modified sequence opt1 from neuraminidase__InfluenzaA__AFN19327

SEQ ID NO: 83928 - RNA, 1410 nt, Artificial Sequence; identical to SEQ ID NO: 77746
  derived and/or modified sequence opt1 from neuraminidase__InfluenzaA__AFN19346

SEQ ID NO: 83929 - RNA, 1410 nt, Artificial Sequence
  derived and/or modified sequence opt1 from neuraminidase__InfluenzaA__AFN19352
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcgggcacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccggagcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83930 - RNA, 1410 nt, Artificial Sequence
  derived and/or modified sequence opt1 from neuraminidase__InfluenzaA__AFN19354
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83931 - RNA, 1410 nt, Artificial Sequence; identical to SEQ ID NO: 83930
  derived and/or modified sequence opt1 from neuraminidase__InfluenzaA__AFN19356

SEQ ID NO: 83932 - RNA, 1410 nt, Artificial Sequence; identical to SEQ ID NO: 83930
  derived and/or modified sequence opt1 from neuraminidase__InfluenzaA__AFN19358

SEQ ID NO: 83933 - RNA, 1410 nt, Artificial Sequence; identical to SEQ ID NO: 83930
  derived and/or modified sequence opt1 from neuraminidase__InfluenzaA__AFN19360

SEQ ID NO: 83934 - RNA, 1410 nt, Artificial Sequence
  derived and/or modified sequence opt1 from neuraminidase__InfluenzaA__AFN19362
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgaggggaagcggugcaucaaccgcugcuucuacguggagcugauccggggccgcaaggaggagaccgaggugcucuggaccagcaacagcaucgucguguucugcggcacguccgggaccuacggcaccgggagcuggcccgacggcgccgaccugaaccugaugcccaucuga

SEQ ID NO: 83935 - RNA, 1410 nt, Artificial Sequence; identical to SEQ ID NO: 83930
  derived and/or modified sequence opt1 from neuraminidase__InfluenzaA__AFN19364

SEQ ID NO: 83936 - RNA, 1410 nt, Artificial Sequence; identical to SEQ ID NO: 80526
  derived and/or modified sequence opt1 from neuraminidase__InfluenzaA__AFN19366

SEQ ID NO: 83937 - RNA, 1410 nt, Artificial Sequence; identical to SEQ ID NO: 83930
  derived and/or modified sequence opt1 from neuraminidase__InfluenzaA__AFN19370

SEQ ID NO: 83938 - RNA, 1410 nt, Artificial Sequence
  derived and/or modified sequence opt1 from neuraminidase__InfluenzaA__AFN19374
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucaaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaccgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 83939 - RNA, 1410 nt, Artificial Sequence; identical to SEQ ID NO: 83930
  derived and/or modified sequence opt1 from neuraminidase__InfluenzaA__AFN19376

SEQ ID NO: 83940 - RNA, 1410 nt, Artificial Sequence; identical to SEQ ID NO: 83930
  derived and/or modified sequence opt1 from neuraminidase__InfluenzaA__AFN19378

SEQ ID NO: 83941 - RNA, 1410 nt, Artificial Sequence
  derived and/or modified sequence opt1 from neuraminidase__InfluenzaA__AFN19380
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgagcgaguaccggaacugguccaagccccagugcgacaucaccggguucgcccccuucagcaaggacaacuccauccgccugagcgcgggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgccaccgcguccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggcguucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgccgaccugaaccugaugcccaucuga

SEQ ID NO: 83942 - RNA, 1410 nt, Artificial Sequence; identical to SEQ ID NO: 83938
  derived and/or modified sequence opt1 from neuraminidase__InfluenzaA__AFN19382

SEQ ID NO: 83943 - RNA, 1410 nt, Artificial Sequence; identical to SEQ ID NO: 83930
  derived and/or modified sequence opt1 from neuraminidase__InfluenzaA__AFN19384

SEQ ID NO: 83944 - RNA, 1410 nt, Artificial Sequence
  derived and/or modified sequence opt1 from neuraminidase__InfluenzaA__AFN19386
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccagaucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 83945 - RNA, 1410 nt, Artificial Sequence; identical to SEQ ID NO: 83930
  derived and/or modified sequence opt1 from neuraminidase__InfluenzaA__AFN19388

SEQ ID NO: 83946 - RNA, 1410 nt, Artificial Sequence; identical to SEQ ID NO: 83930
  derived and/or modified sequence opt1 from neuraminidase__InfluenzaA__AFN19390

SEQ ID NO: 83947 - RNA, 1410 nt, Artificial Sequence
  derived and/or modified sequence opt1 from neuraminidase__InfluenzaA__AFN19392
augaaccccaaccagaagaucaucaccaucggcagcgugucccugaccaucagcacgaucugcuucuucaugcagaucgccguccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 83948 - RNA, 1410 nt, Artificial Sequence; identical to SEQ ID NO: 82795
  derived and/or modified sequence opt1 from neuraminidase__InfluenzaA__AFN19394

SEQ ID NO: 83949 - RNA, 1410 nt, Artificial Sequence
  derived and/or modified sequence opt1 from neuraminidase__InfluenzaA__AFN19396
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgaggggaagaacugcaucaaccggugcuucuacguggagcucauccgcggccggaaggaggagaccgaggugcuguggaccagcaacagcaucgucguguucugcggcaccuccgggacguacggcaccgggagcuggccggacggcgccgaccugaaccucaugcccaucuga

SEQ ID NO: 83950 - RNA, 1410 nt, Artificial Sequence
  derived and/or modified sequence opt1 from neuraminidase__InfluenzaA__AFN19398
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggcgcgggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83951 - RNA, 1410 nt, Artificial Sequence
  derived and/or modified sequence opt1 from neuraminidase__InfluenzaA__AFN19400
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgagcgaguaccggaacugguccaagccccagugcgacaucaccggguucgcccccuucagcaaggacaacuccauccgccugagcgacggcggggacaucugggucacccgggagcccuacguguccugcgacccggacaagugcuaccaguucgcgcugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgccaccgccuccuucaucuacaacgggcggcucguggacagcguggucuccuggagcaaggagauccugcgcacccaggaguccgagugcgugugcaucaacggcacgugcaccguggucaugaccgacgggagcgcgagcggcaaggccgacaccaagauccuguucaucgaggagggcaagaucgugcacacguccacccucagcggguccgcccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgcggaccugaaccugaugcccaucuga

SEQ ID NO: 83952 - RNA, 1410 nt, Artificial Sequence; identical to SEQ ID NO: 83930
  derived and/or modified sequence opt1 from neuraminidase__InfluenzaA__AFN19402

SEQ ID NO: 83953 - RNA, 1410 nt, Artificial Sequence; identical to SEQ ID NO: 83930
  derived and/or modified sequence opt1 from neuraminidase__InfluenzaA__AFN19404

SEQ ID NO: 83954 - RNA, 1410 nt, Artificial Sequence; identical to SEQ ID NO: 83930
  derived and/or modified sequence opt1 from neuraminidase__InfluenzaA__AFN19406

SEQ ID NO: 83955 - RNA, 1410 nt, Artificial Sequence; identical to SEQ ID NO: 83930
  derived and/or modified sequence opt1 from neuraminidase__InfluenzaA__AFN19410

SEQ ID NO: 83956 - RNA, 1410 nt, Artificial Sequence; identical to SEQ ID NO: 83930
  derived and/or modified sequence opt1 from neuraminidase__InfluenzaA__AFN19412

SEQ ID NO: 83957 - RNA, 1410 nt, Artificial Sequence; identical to SEQ ID NO: 83930
  derived and/or modified sequence opt1 from neuraminidase__InfluenzaA__AFN19414

SEQ ID NO: 83958 - RNA, 1410 nt, Artificial Sequence; identical to SEQ ID NO: 83930
  derived and/or modified sequence opt1 from neuraminidase__InfluenzaA__AFN19416

SEQ ID NO: 83959 - RNA, 1410 nt, Artificial Sequence
  derived and/or modified sequence opt1 from neuraminidase__InfluenzaA__AFN19418
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggccgggccgacaccaagauccuguucaucgaggagggcaagaucgugcacacgagcacccucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83960 - RNA, 1410 nt, Artificial Sequence
  derived and/or modified sequence opt1 from neuraminidase__InfluenzaA__AFN19420
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83961 - RNA, 1410 nt, Artificial Sequence
  derived and/or modified sequence opt1 from neuraminidase__InfluenzaA__AFN19422
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccgggaacgacaagaacgcgaccgccagcuucaucuacaacggccggcucguggacuccguggucagcugguccaaggaggugcugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 83962 - RNA, 1410 nt, Artificial Sequence
  derived and/or modified sequence opt1 from neuraminidase__InfluenzaA__AFN19426
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacgagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83963 - RNA, 1410 nt, Artificial Sequence; identical to SEQ ID NO: 83930
  derived and/or modified sequence opt1 from neuraminidase__InfluenzaA__AFN19428

SEQ ID NO: 83964 - RNA, 1410 nt, Artificial Sequence
  derived and/or modified sequence opt1 from neuraminidase__InfluenzaA__AFN19430
augaaccccaaccagaagaucaucaccaucggcagcgugucccugaccaucagcacgaucugcuucuucaugcagaucgccauccucaucaucaccgucacccugcacuucaagcaguacgaguucaacuccccgcccaacaaccaggugaugcugugcgagcccaccaucaucgagcgcaacaugacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcaccuccggcacguacgggaccggcagcuggcccgacggggccgaccugaaccugaugcccaucuga

SEQ ID NO: 83965 - RNA, 1410 nt, Artificial Sequence
  derived and/or modified sequence opt1 from neuraminidase__InfluenzaA__AFN19432
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggaccccgcaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83966 - RNA, 1410 nt, Artificial Sequence
  derived and/or modified sequence opt1 from neuraminidase__InfluenzaA__AFN19434
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugaugcccaucuga

SEQ ID NO: 83967 - RNA, 1410 nt, Artificial Sequence; identical to SEQ ID NO: 83154
  derived and/or modified sequence opt1 from neuraminidase__InfluenzaA__AFN19436

SEQ ID NO: 83968 - RNA, 1410 nt, Artificial Sequence
  derived and/or modified sequence opt1 from neuraminidase__InfluenzaA__AFN19438
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugauguccaucuga

SEQ ID NO: 83969 - RNA, 1410 nt, Artificial Sequence
  derived and/or modified sequence opt1 from neuraminidase__InfluenzaA__AFN19442
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccgacggaguaccggaacuggagcaagccccagugcgacaucaccggguucgcccccuucuccaaggacaacagcauccgccuguccgcgggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgccaccgcgagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcccagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggcguucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcacaucuga

SEQ ID NO: 83970 - RNA, 1410 nt, Artificial Sequence; identical to SEQ ID NO: 83154
  derived and/or modified sequence opt1 from neuraminidase__InfluenzaA__AFN19446

SEQ ID NO: 83971 - RNA, 1410 nt, Artificial Sequence; identical to SEQ ID NO: 83154
  derived and/or modified sequence opt1 from neuraminidase__InfluenzaA__AFN19448

SEQ ID NO: 83972 - RNA, 1410 nt, Artificial Sequence; identical to SEQ ID NO: 83930
  derived and/or modified sequence opt1 from neuraminidase__InfluenzaA__AFN19458

SEQ ID NO: 83973 - RNA, 1410 nt, Artificial Sequence
  derived and/or modified sequence opt1 from neuraminidase__InfluenzaA__AFN19460
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaacgagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaacgaggugcucuggaccagcaacuccaucguggucuucugcgggaccagcggcacguacgggaccggcuccuggcccgacggggccgaccugaaccugaugcccaucuga

SEQ ID NO: 83974 - RNA, 1410 nt, Artificial Sequence; identical to SEQ ID NO: 83154
  derived and/or modified sequence opt1 from neuraminidase__InfluenzaA__AFN19462

SEQ ID NO: 83975 - RNA, 1410 nt, Artificial Sequence
  derived and/or modified sequence opt1 from neuraminidase__InfluenzaA__AFN19466
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucgcgggguucgcccccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccagcuccugccacgacgggaaggcguggcugcacgugugcaucacgggcgacgacaagaacgccaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggcggacaccaagauccuguucaucgaggagggcaagaucgugcacaccagcacgcucuccgggagcgcccagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcaccagcgggacguacggcaccggguccuggcccgacggcgccgaccugaaccugaugcccaucuga

SEQ ID NO: 83976 - RNA, 1410 nt, Artificial Sequence; identical to SEQ ID NO: 83154
  derived and/or modified sequence opt1 from neuraminidase__InfluenzaA__AFN19468

SEQ ID NO: 83977 - RNA, 1410 nt, Artificial Sequence
  derived and/or modified sequence opt1 from neuraminidase__InfluenzaA__AFN19470
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgugaacaaguccgaccggagcggcuacuccgggaucuucagcgucgagggcaagagcugcaucaaccgcugcuucuacguggagcugauccgggggcgcaaggaggagaccgaggugcucuggaccuccaacagcaucgucguguucugcggcacguccggcaccuacgggaccggcagcuggcccgacggggccgaccugaaccugaugcccaucuga

SEQ ID NO: 83978 - RNA, 1410 nt, Artificial Sequence; identical to SEQ ID NO: 83930
  derived and/or modified sequence opt1 from neuraminidase__InfluenzaA__AFN19472

SEQ ID NO: 83979 - RNA, 1410 nt, Artificial Sequence
  derived and/or modified sequence opt1 from neuraminidase__InfluenzaA__AFN19476
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgccccuguccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 83980 - RNA, 1410 nt, Artificial Sequence; identical to SEQ ID NO: 83930
  derived and/or modified sequence opt1 from neuraminidase__InfluenzaA__AFN19478

SEQ ID NO: 83981 - RNA, 1410 nt, Artificial Sequence
  derived and/or modified sequence opt1 from neuraminidase__InfluenzaA__AFN19480
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccgucggcgaccgcacccccuaccggacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggucagcugguccaaggagauccugcggacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgcuacccggggguccggugcgugugccgcgacaacuggaagggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccgccaggugaucguggaccgguccgaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcacguccgggaccuacggcaccgggagcuggcccgacggcgccgaccugaaccugaugcccaucuga

SEQ ID NO: 83982 - RNA, 1410 nt, Artificial Sequence
  derived and/or modified sequence opt1 from neuraminidase__InfluenzaA__AFN19482
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccaaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugaugcccaucuga

SEQ ID NO: 83983 - RNA, 1410 nt, Artificial Sequence; identical to SEQ ID NO: 83154
  derived and/or modified sequence opt1 from neuraminidase__InfluenzaA__AFN19484

SEQ ID NO: 83984 - RNA, 1410 nt, Artificial Sequence; identical to SEQ ID NO: 83930
  derived and/or modified sequence opt1 from neuraminidase__InfluenzaA__AFN19488

SEQ ID NO: 83985 - RNA, 1410 nt, Artificial Sequence
  derived and/or modified sequence opt1 from neuraminidase__InfluenzaA__AFN19492
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggaagcucguggacuccguggucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 83986 - RNA, 1410 nt, Artificial Sequence
  derived and/or modified sequence opt1 from neuraminidase__InfluenzaA__AFN19494
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacaugcacuccaacaacaccgugcgcgaccggaccccguaccgcacccugcucaugaacgagcugggcguccccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaaccucaugcccaucuga

SEQ ID NO: 83987 - RNA, 1410 nt, Artificial Sequence; identical to SEQ ID NO: 82795
  derived and/or modified sequence opt1 from neuraminidase__InfluenzaA__AFN19496

SEQ ID NO: 83988 - RNA, 1410 nt, Artificial Sequence
  derived and/or modified sequence opt1 from neuraminidase__InfluenzaA__AFN19498
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaccgaggagaccgaggugcuguggacgagcaacuccaucgucguguucugcggcaccagcgggaccuacggcaccggguccuggccggacggcgccgaccugaaccucaugcccaucuga

SEQ ID NO: 83989 - RNA, 1410 nt, Artificial Sequence; identical to SEQ ID NO: 83938
  derived and/or modified sequence opt1 from neuraminidase__InfluenzaA__AFN19500

SEQ ID NO: 83990 - RNA, 1410 nt, Artificial Sequence; identical to SEQ ID NO: 83930
  derived and/or modified sequence opt1 from neuraminidase__InfluenzaA__AFN19502

SEQ ID NO: 83991 - RNA, 1410 nt, Artificial Sequence; identical to SEQ ID NO: 80526
  derived and/or modified sequence opt1 from neuraminidase__InfluenzaA__AFN19504

SEQ ID NO: 83992 - RNA, 1410 nt, Artificial Sequence; identical to SEQ ID NO: 80526
  derived and/or modified sequence opt1 from neuraminidase__InfluenzaA__AFN19506

SEQ ID NO: 83993 - RNA, 1410 nt, Artificial Sequence; identical to SEQ ID NO: 83938
  derived and/or modified sequence opt1 from neuraminidase__InfluenzaA__AFN19508

SEQ ID NO: 83994 - RNA, 1410 nt, Artificial Sequence; identical to SEQ ID NO: 83930
  derived and/or modified sequence opt1 from neuraminidase__InfluenzaA__AFN19510

SEQ ID NO: 83995 - RNA, 1410 nt, Artificial Sequence; identical to SEQ ID NO: 83930
  derived and/or modified sequence opt1 from neuraminidase__InfluenzaA__AFN19512

SEQ ID NO: 83996 - RNA, 1410 nt, Artificial Sequence; identical to SEQ ID NO: 83930
  derived and/or modified sequence opt1 from neuraminidase__InfluenzaA__AFN19516

SEQ ID NO: 83997 - RNA, 1410 nt, Artificial Sequence; identical to SEQ ID NO: 83938
  derived and/or modified sequence opt1 from neuraminidase__InfluenzaA__AFN19518

SEQ ID NO: 83998 - RNA, 1410 nt, Artificial Sequence; identical to SEQ ID NO: 83938
  derived and/or modified sequence opt1 from neuraminidase__InfluenzaA__AFN19520

SEQ ID NO: 83999 - RNA, 1410 nt, Artificial Sequence; identical to SEQ ID NO: 83930
  derived and/or modified sequence opt1 from neuraminidase__InfluenzaA__AFN19522

SEQ ID NO: 84000 - RNA, 1410 nt, Artificial Sequence
  derived and/or modified sequence opt1 from neuraminidase__InfluenzaA__AFN19524
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugagccugaugcccaucuga

SEQ ID NO: 84001 - RNA, 1410 nt, Artificial Sequence
  derived and/or modified sequence opt1 from neuraminidase__InfluenzaA__AFN19526
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaccgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagacggacuccagcuccagcucccacugccuggaccccaacaacgaggagggcggccacggggucaagggcugggccuucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagacggaggugcucuggaccagcaacuccaucgucguguucugcggcaccagcgggaccuacggcacgggguccuggcccgacggcgccgaccugaaccugaugcccaucuga

SEQ ID NO: 84002 - RNA, 1410 nt, Artificial Sequence
  derived and/or modified sequence opt1 from neuraminidase__InfluenzaA__AFN19528
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaagagcgacaccaagauccuguucaucgaggagggcaagaucgugcacacguccacccucagcggguccgcccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggcguucgacgacgggaacgacguguggaugggccgcaccaucaacgagaccucccggcucggcuacgagaccuucaaggucaucgagggguggagcaacccgaaguccaagcugcagaucaaccgccaggugaucguggaccggagcgaccgcuccggcuacagcgggaucuucagcgucgagggcaaguccugcaucaaccggugcuucuacguggagcugauccgcgggcggaaggaggagaccgaggugcucuggaccagcaacuccaucgucguguucugcggcacgagcggcaccuacgggaccggcuccuggcccgacggggccgaccugaaccugaugcccaucuga

SEQ ID NO: 84003 - RNA, 1410 nt, Artificial Sequence; identical to SEQ ID NO: 83966
  derived and/or modified sequence opt1 from neuraminidase__InfluenzaA__AFN19530

SEQ ID NO: 84004 - RNA, 1410 nt, Artificial Sequence; identical to SEQ ID NO: 83930
  derived and/or modified sequence opt1 from neuraminidase__InfluenzaA__AFN19532

SEQ ID NO: 84005 - RNA, 1410 nt, Artificial Sequence; identical to SEQ ID NO: 83966
  derived and/or modified sequence opt1 from neuraminidase__InfluenzaA__AFN19534

SEQ ID NO: 84006 - RNA, 1410 nt, Artificial Sequence; identical to SEQ ID NO: 83930
  derived and/or modified sequence opt1 from neuraminidase__InfluenzaA__AFN19536

SEQ ID NO: 84007 - RNA, 1410 nt, Artificial Sequence; identical to SEQ ID NO: 83930
  derived and/or modified sequence opt1 from neuraminidase__InfluenzaA__AFN19538

SEQ ID NO: 84008 - RNA, 1410 nt, Artificial Sequence; identical to SEQ ID NO: 83930
  derived and/or modified sequence opt1 from neuraminidase__InfluenzaA__AFN19544

SEQ ID NO: 84009 - RNA, 1410 nt, Artificial Sequence
  derived and/or modified sequence opt1 from neuraminidase__InfluenzaA__AFN19546
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugagcgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggcccgacggggccgaccugaaccugaugcccaucuga

SEQ ID NO: 84010 - RNA, 1410 nt, Artificial Sequence
  derived and/or modified sequence opt1 from neuraminidase__InfluenzaA__AFN19548
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccuucagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgaggggaaguccugcaucaaccggugcuucuacguggagcugauccgcggccggaaggaggagaccgaggugcucuggaccagcaacagcaucgucguguucugcggcacguccgggaccuacggcaccgggagcuggcccgacggcgccgaccugaaccugaugcccaucuga

SEQ ID NO: 84011 - RNA, 1410 nt, Artificial Sequence
  derived and/or modified sequence opt1 from neuraminidase__InfluenzaA__AFN19550
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcgaggccgacaccaagauccucuucaucgaggagggcaagaucauccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaaccucaugcccaucuga

SEQ ID NO: 84012 - RNA, 1410 nt, Artificial Sequence; identical to SEQ ID NO: 83930
  derived and/or modified sequence opt1 from neuraminidase__InfluenzaA__AFN19552

SEQ ID NO: 84013 - RNA, 1410 nt, Artificial Sequence; identical to SEQ ID NO: 83154
  derived and/or modified sequence opt1 from neuraminidase__InfluenzaA__AFN19554

SEQ ID NO: 84014 - RNA, 1410 nt, Artificial Sequence; identical to SEQ ID NO: 83154
  derived and/or modified sequence opt1 from neuraminidase__InfluenzaA__AFN19556

SEQ ID NO: 84015 - RNA, 1410 nt, Artificial Sequence
  derived and/or modified sequence opt1 from neuraminidase__InfluenzaA__AFN19558
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaugaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84016 - RNA, 1410 nt, Artificial Sequence
  derived and/or modified sequence opt1 from neuraminidase__InfluenzaA__AFN19560
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgagggcgggggccacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84017 - RNA, 1410 nt, Artificial Sequence; identical to SEQ ID NO: 83977
  derived and/or modified sequence opt1 from neuraminidase__InfluenzaA__AFN19562

SEQ ID NO: 84018 - RNA, 1410 nt, Artificial Sequence
  derived and/or modified sequence opt1 from neuraminidase__InfluenzaA__AFN19564
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaccgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 84019 - RNA, 1410 nt, Artificial Sequence
  derived and/or modified sequence opt1 from neuraminidase__InfluenzaA__AFN19566
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaacgagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaacgaggugcucuggaccagcaacuccaucgucguguucugcgggaccagcggcacguacgggaccggcuccuggcccgacggggccgaccugaaccugaugcccaucuga

SEQ ID NO: 84020 - RNA, 1410 nt, Artificial Sequence
  derived and/or modified sequence opt1 from neuraminidase__InfluenzaA__AFN19568
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcuccaggugaaccgccaggugaucgucgaccgcggggaccgguccggcuacagcgggaucuucuccguggagggcaagagcugcaucaaccggugcuucuacguggagcugauccgcggccggaaggaggagaucgagguccuguggaccagcaacuccaucgugguguucugcgggaccagcggcacguacgggaccggcuccuggcccgacggggccgaccugaaccugaugcccaucuga

SEQ ID NO: 84021 - RNA, 1410 nt, Artificial Sequence
  derived and/or modified sequence opt1 from neuraminidase__InfluenzaA__AFN19570
augaaccccaaccagaagaucaucaccaucggcagcgugucccugaccaucagcacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacaugcacagcaacaacaccgugcgcgaccggacccccuaccgcacccugcugaugaacgagcucggcguccccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcgugguguccuggagcaacgagauccugcgcacccaggaguccgagugcgucugcaucaacgggacgugcaccguggugaugaccgacggcagcgccuccggcaaggccgacaccaagauccuguucaucgaggaggggaagaucguccacacgagcacccucagcggcuccgcgcagcacguggaggagugcagcugcuacccccgguacccgggggugcgcugcgucugccgggacaacuggaagggcuccaaccgccccaucguggacaucaacaucaaggaccacagcaucguguccagcuacgucugcuccggccuggugggggacacgccccggaagaacgacagcuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggucaucguggaccgcggggaccggagcggcuacuccgggaucuucagcguggagggcaaguccugcaucaaccggugcuucuacgucgagcugauccgcggccggaaggaggagaacgaggugcucuggaccagcaacagcaucguggucuucugcgggaccuccggcacguacgggaccggcagcuggcccgacggggccgaccugaaccugaugcccaucuga

SEQ ID NO: 84022 - RNA, 1410 nt, Artificial Sequence
  derived and/or modified sequence opt1 from neuraminidase__InfluenzaA__AFN19572
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgcaucuccgccggcggggacaucugggucacccgggagcccuacgugagcugcgacccggacaagugcuaccaguucgcccugggccaggggaccacgcugaacaacgugcacuccaacaacaccguccgcgaccggacccccuaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccucgugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccugggcuacgagaccuucaaggucaucgaggggugguccaaccccaagagcaagcuccagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggcccgacggcgccgaccucaaccugaugcccaucuga

SEQ ID NO: 84023 - RNA, 1410 nt, Artificial Sequence
  derived and/or modified sequence opt1 from neuraminidase__InfluenzaA__AFN19574
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaagaagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgacuccagcuccagcucccacugcuucgaccccaacgacgaggagggcgggcacggggucaagggcugggccuucgacgacgggaacgacguguggaugggccgcaccaucagcgagaagucccggcucggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcugauccgcggguccaaggaggagaccgaggugcucuggaccagcaacuccaucgucguguucugcggcaccagcgggacguacggcaccggguccuggccggacggcgccgacaucaaccugaugcccaucuga

SEQ ID NO: 84024 - RNA, 1410 nt, Artificial Sequence
  derived and/or modified sequence opt1 from neuraminidase__InfluenzaA__AFN19576
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgucagcugcgacccggacaagugcuaccaguucgcccugggccaggggaccacgcucaacaacgugcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 84025 - RNA, 1410 nt, Artificial Sequence; identical to SEQ ID NO: 83930
  derived and/or modified sequence opt1 from neuraminidase__InfluenzaA__AFN19578

SEQ ID NO: 84026 - RNA, 1410 nt, Artificial Sequence; identical to SEQ ID NO: 83930
  derived and/or modified sequence opt1 from neuraminidase__InfluenzaA__AFN19582

SEQ ID NO: 84027 - RNA, 1410 nt, Artificial Sequence; identical to SEQ ID NO: 83930
  derived and/or modified sequence opt1 from neuraminidase__InfluenzaA__AFN19584

SEQ ID NO: 84028 - RNA, 1410 nt, Artificial Sequence; identical to SEQ ID NO: 83930
  derived and/or modified sequence opt1 from neuraminidase__InfluenzaA__AFN19588

SEQ ID NO: 84029 - RNA, 1410 nt, Artificial Sequence; identical to SEQ ID NO: 83930
  derived and/or modified sequence opt1 from neuraminidase__InfluenzaA__AFN19590

SEQ ID NO: 84030 - RNA, 1410 nt, Artificial Sequence; identical to SEQ ID NO: 83966
  derived and/or modified sequence opt1 from neuraminidase__InfluenzaA__AFN19592

SEQ ID NO: 84031 - RNA, 1410 nt, Artificial Sequence; identical to SEQ ID NO: 83930
  derived and/or modified sequence opt1 from neuraminidase__InfluenzaA__AFN19594

SEQ ID NO: 84032 - RNA, 1410 nt, Artificial Sequence; identical to SEQ ID NO: 83938
  derived and/or modified sequence opt1 from neuraminidase__InfluenzaA__AFN19596

SEQ ID NO: 84033 - RNA, 1410 nt, Artificial Sequence; identical to SEQ ID NO: 83938
  derived and/or modified sequence opt1 from neuraminidase__InfluenzaA__AFN19600

SEQ ID NO: 84034 - RNA, 1410 nt, Artificial Sequence
  derived and/or modified sequence opt1 from neuraminidase__InfluenzaA__AFN19602
augaaccccaaccagaagaucaucaccaucggcagcgugucccugacccucagcacgaucugcuucuucaugcagaucgccauccugaucaccaccgucacccugcacuucaagcaguacgaguucaacuccccgcccaacaaccaggugaugcucugcgagcccacgaucaucgagcgcaacaugaccgagaucguguaccugaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccucggccaggggaccacgcugaacaacgugcacuccaacaacaccguccgcgaccggacccccuaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccucgaccccaacaacgaggagggcgggcacggggucaagggcugggccuucgacgacgggaacgacguguggaugggccgcaccaucaacgagacgagccggcugggcuacgagaccuucaaggucaucgaggggugguccaaccccaagagcaagcugcagaucaaccgccaggugaucguggaccgguccgaccgcagcggcuacuccgggaucuucagcgucgagggcaagagcugcaucaaccggugcuucuacguggagcucauccgcgggcggaaggaggagaccgaggugcuguggaccuccaacagcaucgucguguucugcggcacguccggcaccuacgggaccggcagcuggcccgacggggccgaccugaaccucaugcccaucuga

SEQ ID NO: 84035 - RNA, 1410 nt, Artificial Sequence; identical to SEQ ID NO: 83930
  derived and/or modified sequence opt1 from neuraminidase__InfluenzaA__AFN19604

SEQ ID NO: 84036 - RNA, 1410 nt, Artificial Sequence; identical to SEQ ID NO: 83930
  derived and/or modified sequence opt1 from neuraminidase__InfluenzaA__AFN19606

SEQ ID NO: 84037 - RNA, 1410 nt, Artificial Sequence; identical to SEQ ID NO: 83930
  derived and/or modified sequence opt1 from neuraminidase__InfluenzaA__AFN19608

SEQ ID NO: 84038 - RNA, 1410 nt, Artificial Sequence; identical to SEQ ID NO: 83930
  derived and/or modified sequence opt1 from neuraminidase__InfluenzaA__AFN19610

SEQ ID NO: 84039 - RNA, 1410 nt, Artificial Sequence; identical to SEQ ID NO: 83938
  derived and/or modified sequence opt1 from neuraminidase__InfluenzaA__AFN19612

SEQ ID NO: 84040 - RNA, 1410 nt, Artificial Sequence; identical to SEQ ID NO: 83154
  derived and/or modified sequence opt1 from neuraminidase__InfluenzaA__AFN19614

SEQ ID NO: 84041 - RNA, 1410 nt, Artificial Sequence
  derived and/or modified sequence opt1 from neuraminidase__InfluenzaA__AFN19618
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaacgagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84042 - RNA, 1410 nt, Artificial Sequence; identical to SEQ ID NO: 83930
  derived and/or modified sequence opt1 from neuraminidase__InfluenzaA__AFN19620

SEQ ID NO: 84043 - RNA, 1410 nt, Artificial Sequence; identical to SEQ ID NO: 83966
  derived and/or modified sequence opt1 from neuraminidase__InfluenzaA__AFN19624

SEQ ID NO: 84044 - RNA, 1410 nt, Artificial Sequence; identical to SEQ ID NO: 83930
  derived and/or modified sequence opt1 from neuraminidase__InfluenzaA__AFN19630

SEQ ID NO: 84045 - RNA, 1410 nt, Artificial Sequence
  derived and/or modified sequence opt1 from neuraminidase__InfluenzaA__AFN19632
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgaccgaguaccggaacuggagcaagccccagugcgacaucaccggguucgcccccuucuccaaggacaacagcauccgccuguccgcgggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgccaccgcgagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcccagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggcguucgacgacgggaacgacguguggaugggccgcacgaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggcccgacggcgccgaccugaaccugaugcccaucuga

SEQ ID NO: 84046 - RNA, 1410 nt, Artificial Sequence
  derived and/or modified sequence opt1 from neuraminidase__InfluenzaA__AFN19634
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggaccagcuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaaccccaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggccggacggcgccgaccugaaccugaugcccaucuga

SEQ ID NO: 84047 - RNA, 1410 nt, Artificial Sequence
  derived and/or modified sequence opt1 from neuraminidase__InfluenzaA__AFN19636
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccaucaucgagaaggagaucugccccaagccgacggaguaccggaacuggagcaagccccagugcgacaucaccggguucgcccccuucuccaaggacaacagcauccgccuguccgcgggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgccaccgcgagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcccagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggcguucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84048 - RNA, 1410 nt, Artificial Sequence; identical to SEQ ID NO: 84047
  derived and/or modified sequence opt1 from neuraminidase__InfluenzaA__AFN19638

SEQ ID NO: 84049 - RNA, 1410 nt, Artificial Sequence; identical to SEQ ID NO: 83930
  derived and/or modified sequence opt1 from neuraminidase__InfluenzaA__AFN19640

SEQ ID NO: 84050 - RNA, 1410 nt, Artificial Sequence
  derived and/or modified sequence opt1 from neuraminidase__InfluenzaA__AFN19642
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccgucagcgaccgcacccccuaccggacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcgccucguggacagcguggucuccuggagcaaggagauccugcggacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgcuacccgggcguccggugcgugugccgcgacaacuggaagggguccaaccggcccaucguggacaucaacaucaaggaccacagcaucgucuccagcuacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccgccaggugaucguggaccggagcgaccgguccggcuacagcgggaucuucagcgucgagggcaaguccugcaucaaccgcugcuucuacguggagcugauccgggggcgcaaggaggagaccgaggugcucuggaccagcaacuccaucgucguguucugcggcacgagcggcaccuacgggaccggcuccuggcccgacggggccgaccugaaccugaugcccaucuga

SEQ ID NO: 84051 - RNA, 1410 nt, Artificial Sequence; identical to SEQ ID NO: 84047
  derived and/or modified sequence opt1 from neuraminidase__InfluenzaA__AFN19644

SEQ ID NO: 84052 - RNA, 1410 nt, Artificial Sequence
  derived and/or modified sequence opt1 from neuraminidase__InfluenzaA__AFN19646
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgugaaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugaugcccaucuga

SEQ ID NO: 84053 - RNA, 1410 nt, Artificial Sequence; identical to SEQ ID NO: 83930
  derived and/or modified sequence opt1 from neuraminidase__InfluenzaA__AFN19648

SEQ ID NO: 84054 - RNA, 1410 nt, Artificial Sequence; identical to SEQ ID NO: 83966
  derived and/or modified sequence opt1 from neuraminidase__InfluenzaA__AFN19650

SEQ ID NO: 84055 - RNA, 1410 nt, Artificial Sequence
  derived and/or modified sequence opt1 from neuraminidase__InfluenzaA__AFN19652
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 84056 - RNA, 1410 nt, Artificial Sequence
  derived and/or modified sequence opt1 from neuraminidase__InfluenzaA__AFN19654
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagccgaccgaguaccggaacuggagcaagccccagugcgacaucaccggguucgcccccuucuccaaggacaacagcauccgccuguccgcgggcggggacaucugggucacgcgggagcccuacgugagcugcgacccggacaagugcuaccaguucgcccugggccaggggaccacccucaacaacgugcacuccaacaacaccguccgcgaccggacgcccuaccgcacccugcugaugaacgagcucggcgugcccuuccaccugggcaccaagcaggucugcaucgccuggagcuccagcuccugccacgacgggaaggccuggcugcacgugugcaucaccggcgacgacaagaacgccacggcgagcuucaucuacaacgggcggcucguggacuccguggucagcugguccaaggagauccugcgcacccaggagagcgagugcgugugcaucaacgggaccugcaccguggucaugacggacggguccgccagcggcaaggccgacaccaagauccuguucaucgaggagggcaagaucgugcacaccagcacccucuccgggagcgcccagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacacgccccggaagaacgacuccagcuccagcucccacugccuggaccccaacaacgaggagggcggccacggggucaagggcugggcguucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagacggaggugcucuggaccagcaacuccaucgucguguucugcggcaccagcgggaccuacggcacgggguccuggccggacggcgccgaccugaaccugaugcccaucuga

SEQ ID NO: 84057 - RNA, 1410 nt, Artificial Sequence; identical to SEQ ID NO: 83930
  derived and/or modified sequence opt1 from neuraminidase__InfluenzaA__AFN19656

SEQ ID NO: 84058 - RNA, 1410 nt, Artificial Sequence; identical to SEQ ID NO: 83154
  derived and/or modified sequence opt1 from neuraminidase__InfluenzaA__AFN19658

SEQ ID NO: 84059 - RNA, 1410 nt, Artificial Sequence; identical to SEQ ID NO: 84047
  derived and/or modified sequence opt1 from neuraminidase__InfluenzaA__AFN19660

SEQ ID NO: 84060 - RNA, 1410 nt, Artificial Sequence; identical to SEQ ID NO: 83154
  derived and/or modified sequence opt1 from neuraminidase__InfluenzaA__AFN19662

SEQ ID NO: 84061 - RNA, 1410 nt, Artificial Sequence
  derived and/or modified sequence opt1 from neuraminidase__InfluenzaA__AFN19664
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaacaccaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgacaccaagauccuguucaucgaggaggggaagaucgugcacaccagcacgcucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 84062 - RNA, 1410 nt, Artificial Sequence
  derived and/or modified sequence opt1 from neuraminidase__InfluenzaA__AFN19666
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgugaaccgguccgaccgcagcggcuacuccgggaucuucagcgucgagggcaagagcugcaucaaccggugcuucuacguggagcugauccgcgggcggaaggaggagaccgaggugcucuggaccuccaacagcaucgucguguucugcggcacguccggcaccuacgggaccggcagcuggcccgacggggccgaccugaaccugaugcccaucuga

SEQ ID NO: 84063 - RNA, 1410 nt, Artificial Sequence
  derived and/or modified sequence opt1 from neuraminidase__InfluenzaA__AFN19668
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaugaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgagcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccgguccgaccgcagcggcuacuccgggaucuucagcguggagggcaagagcugcaucaaccggugcuucuacgucgagcugauccgcgggcggaaggaggagaccgaggugcucuggaccuccaacagcaucguggucuucugcggcacguccggcaccuacgggaccggcagcuggcccgacggggccgaccugaaccugaugcccaucuga

SEQ ID NO: 84064 - RNA, 1410 nt, Artificial Sequence; identical to SEQ ID NO: 83966
  derived and/or modified sequence opt1 from neuraminidase__InfluenzaA__AFN19670

SEQ ID NO: 84065 - RNA, 1410 nt, Artificial Sequence; identical to SEQ ID NO: 83154
  derived and/or modified sequence opt1 from neuraminidase__InfluenzaA__AFN19673

SEQ ID NO: 84066 - RNA, 1410 nt, Artificial Sequence; identical to SEQ ID NO: 83930
  derived and/or modified sequence opt1 from neuraminidase__InfluenzaA__AFN19675

SEQ ID NO: 84067 - RNA, 1410 nt, Artificial Sequence
  derived and/or modified sequence opt1 from neuraminidase__InfluenzaA__AFN19677
augaaccccaaccagaagaucaucaccaucggcagcgugucccugaccaucagcaucaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcaccagcgggacguacggcaccggguccuggcccgacggcgccgaccugaaccugaugcccaucuga

SEQ ID NO: 84068 - RNA, 1410 nt, Artificial Sequence; identical to SEQ ID NO: 83966
  derived and/or modified sequence opt1 from neuraminidase__InfluenzaA__AFN19683

SEQ ID NO: 84069 - RNA, 1410 nt, Artificial Sequence; identical to SEQ ID NO: 83930
  derived and/or modified sequence opt1 from neuraminidase__InfluenzaA__AFN19685

SEQ ID NO: 84070 - RNA, 1410 nt, Artificial Sequence; identical to SEQ ID NO: 83930
  derived and/or modified sequence opt1 from neuraminidase__InfluenzaA__AFN19687

SEQ ID NO: 84071 - RNA, 1410 nt, Artificial Sequence; identical to SEQ ID NO: 83930
  derived and/or modified sequence opt1 from neuraminidase__InfluenzaA__AFN19689

SEQ ID NO: 84072 - RNA, 1410 nt, Artificial Sequence; identical to SEQ ID NO: 83154
  derived and/or modified sequence opt1 from neuraminidase__InfluenzaA__AFN19691

SEQ ID NO: 84073 - RNA, 1410 nt, Artificial Sequence
  derived and/or modified sequence opt1 from neuraminidase__InfluenzaA__AFN19693
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcuccaacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgaggggaagaacugcaucaaccggugcuucuacguggagcucauccgcggccggaaggaggagaccgaggugcuguggaccagcaacagcaucgucguguucugcggcaccuccgggacguacggcaccgggagcuggccggacggcgccgaccugaaccucaugcccaucuga

SEQ ID NO: 84074 - RNA, 1410 nt, Artificial Sequence
  derived and/or modified sequence opt1 from neuraminidase__InfluenzaA__AFN19697
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagacccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 84075 - RNA, 1410 nt, Artificial Sequence; identical to SEQ ID NO: 83930
  derived and/or modified sequence opt1 from neuraminidase__InfluenzaA__AFN19699

SEQ ID NO: 84076 - RNA, 1410 nt, Artificial Sequence; identical to SEQ ID NO: 83966
  derived and/or modified sequence opt1 from neuraminidase__InfluenzaA__AFN19701

SEQ ID NO: 84077 - RNA, 1410 nt, Artificial Sequence
  derived and/or modified sequence opt1 from neuraminidase__InfluenzaA__AFN19703
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucgacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84078 - RNA, 1410 nt, Artificial Sequence; identical to SEQ ID NO: 81265
  derived and/or modified sequence opt1 from neuraminidase__InfluenzaA__AFN19711

SEQ ID NO: 84079 - RNA, 1410 nt, Artificial Sequence
  derived and/or modified sequence opt1 from neuraminidase__InfluenzaA__AFN19721
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagccccauggagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 84080 - RNA, 1410 nt, Artificial Sequence; identical to SEQ ID NO: 82086
  derived and/or modified sequence opt1 from neuraminidase__InfluenzaA__AFN19731

SEQ ID NO: 84081 - RNA, 1410 nt, Artificial Sequence; identical to SEQ ID NO: 81265
  derived and/or modified sequence opt1 from neuraminidase__InfluenzaA__AFN19737

SEQ ID NO: 84082 - RNA, 1410 nt, Artificial Sequence
  derived and/or modified sequence opt1 from neuraminidase__InfluenzaA__AFN19747
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucacccacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 84083 - RNA, 1410 nt, Artificial Sequence; identical to SEQ ID NO: 81265
  derived and/or modified sequence opt1 from neuraminidase__InfluenzaA__AFN19749

SEQ ID NO: 84084 - RNA, 1410 nt, Artificial Sequence; identical to SEQ ID NO: 81265
  derived and/or modified sequence opt1 from neuraminidase__InfluenzaA__AFN19759

SEQ ID NO: 84085 - RNA, 1410 nt, Artificial Sequence
  derived and/or modified sequence opt1 from neuraminidase__InfluenzaA__AFN19769
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaaccgcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 84086 - RNA, 1410 nt, Artificial Sequence; identical to SEQ ID NO: 81265
  derived and/or modified sequence opt1 from neuraminidase__InfluenzaA__AFN19783

SEQ ID NO: 84087 - RNA, 1410 nt, Artificial Sequence; identical to SEQ ID NO: 81966
  derived and/or modified sequence opt1 from neuraminidase__InfluenzaA__AFN19793

SEQ ID NO: 84088 - RNA, 1410 nt, Artificial Sequence; identical to SEQ ID NO: 81265
  derived and/or modified sequence opt1 from neuraminidase__InfluenzaA__AFN19807

SEQ ID NO: 84089 - RNA, 1410 nt, Artificial Sequence
  derived and/or modified sequence opt1 from neuraminidase__InfluenzaA__AFN19809
augaaccccaaccagaagaucaucaccaucggcagcgugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucaucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagagcgucgccugguccgcgagcgccugccacgacgggaucaacuggcucacgaucggcaucuccggccccgacaacggggccguggccgugcugaaguacaacggcaucaucaccgacaccaucaagagcuggcgcaacaacauccugcggacccaggaguccgagugcgcgugcgucaacgggagcugcuucacggugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccaccaacggggccaacggcgugaagggguucagcuucaaguacggcaacgggguguggaucggccgcaccaaguccaucagcagccggaacggcuucgagaugaucugggaccccaacggguggaccggcaccgacaacaaguucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84090 - RNA, 1410 nt, Artificial Sequence; identical to SEQ ID NO: 82088
  derived and/or modified sequence opt1 from neuraminidase__InfluenzaA__AFN19815

SEQ ID NO: 84091 - RNA, 1410 nt, Artificial Sequence
  derived and/or modified sequence opt1 from neuraminidase__InfluenzaA__AFN19833
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggaagaacaacauccugcgcacgcaggagagcgagugcgcgugcgugaacggguccugcuucaccaucaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 84092 - RNA, 1410 nt, Artificial Sequence; identical to SEQ ID NO: 81724
  derived and/or modified sequence opt1 from neuraminidase__InfluenzaA__AFN19851

SEQ ID NO: 84093 - RNA, 1410 nt, Artificial Sequence; identical to SEQ ID NO: 81265
  derived and/or modified sequence opt1 from neuraminidase__InfluenzaA__AFN19857

SEQ ID NO: 84094 - RNA, 1410 nt, Artificial Sequence
  derived and/or modified sequence opt1 from neuraminidase__InfluenzaA__AFN19867
augaaccccaaccagaagaucaucaccaucggcagcgugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccaucaucaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 84095 - RNA, 1410 nt, Artificial Sequence; identical to SEQ ID NO: 81717
  derived and/or modified sequence opt1 from neuraminidase__InfluenzaA__AFN19877

SEQ ID NO: 84096 - RNA, 1410 nt, Artificial Sequence; identical to SEQ ID NO: 81265
  derived and/or modified sequence opt1 from neuraminidase__InfluenzaA__AFN19887

SEQ ID NO: 84097 - RNA, 1410 nt, Artificial Sequence
  derived and/or modified sequence opt1 from neuraminidase__InfluenzaA__AFN19897
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccugcaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84098 - RNA, 1410 nt, Artificial Sequence; identical to SEQ ID NO: 81265
  derived and/or modified sequence opt1 from neuraminidase__InfluenzaA__AFN19907

SEQ ID NO: 84099 - RNA, 1410 nt, Artificial Sequence; identical to SEQ ID NO: 81724
  derived and/or modified sequence opt1 from neuraminidase__InfluenzaA__AFN19917

SEQ ID NO: 84100 - RNA, 1410 nt, Artificial Sequence
  derived and/or modified sequence opt1 from neuraminidase__InfluenzaA__AFN19923
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccagaacgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84101 - RNA, 1410 nt, Artificial Sequence; identical to SEQ ID NO: 81265
  derived and/or modified sequence opt1 from neuraminidase__InfluenzaA__AFN19933

SEQ ID NO: 84102 - RNA, 1410 nt, Artificial Sequence; identical to SEQ ID NO: 81724
  derived and/or modified sequence opt1 from neuraminidase__InfluenzaA__AFN19943

SEQ ID NO: 84103 - RNA, 1410 nt, Artificial Sequence
  derived and/or modified sequence opt1 from neuraminidase__InfluenzaA__AFN19953
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccagcgcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccaucaugaccgacggcccguccgacggccaggccagcuacaagaucuuccggaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugagcuucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaagggcuucgagaugaucugggaccccaacggguggaccggcaccgacaacaacuucagcaucaagcaggacaucgucgagaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 84104 - RNA, 1410 nt, Artificial Sequence
  derived and/or modified sequence opt1 from neuraminidase__InfluenzaA__AFN19967
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcagcaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84105 - RNA, 1410 nt, Artificial Sequence
  derived and/or modified sequence opt1 from neuraminidase__InfluenzaA__AFN19973
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcagcuccgacggccaggccagcuacaagaucuuccgcaucgagaaggggaagaucgugaaguccgucgagaugaacgccccgaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccccggccgaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 84106 - RNA, 1410 nt, Artificial Sequence; identical to SEQ ID NO: 81265
  derived and/or modified sequence opt1 from neuraminidase__InfluenzaA__AFN19979

SEQ ID NO: 84107 - RNA, 1410 nt, Artificial Sequence
  derived and/or modified sequence opt1 from neuraminidase__InfluenzaA__AFN19985
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcgucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84108 - RNA, 1410 nt, Artificial Sequence
  derived and/or modified sequence opt1 from neuraminidase__InfluenzaA__AFN19995
augaaccccaaccagaagaucaucaccaucggcagcgugugcaugaccaucgggauggccaaccugauccuccagaucggcaacaucaucuccaucuggaucagccacuccauccagcuggggaaccagagccagacggagaccugcaaccaguccgucaucaccuacgagaacaacaccugggugaaccagacguacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggagccccuaccgcacccugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 84109 - RNA, 1410 nt, Artificial Sequence; identical to SEQ ID NO: 81265
  derived and/or modified sequence opt1 from neuraminidase__InfluenzaA__AFN20001

SEQ ID NO: 84110 - RNA, 1410 nt, Artificial Sequence
  derived and/or modified sequence opt1 from neuraminidase__InfluenzaA__AFN20013
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcgaccccgucagcuccaacggcgccaacggggugaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 84111 - RNA, 1410 nt, Artificial Sequence
  derived and/or modified sequence opt1 from neuraminidase__InfluenzaA__AFN20020
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggcugaacgaguggagcggcuacuccgggagcuucgugcagcacccggagcugacgggccucgacugcauccgccccugcuucuggguggagcugauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84112 - RNA, 1410 nt, Artificial Sequence; identical to SEQ ID NO: 81265
  derived and/or modified sequence opt1 from neuraminidase__InfluenzaA__AFN20022

SEQ ID NO: 84113 - RNA, 1410 nt, Artificial Sequence
  derived and/or modified sequence opt1 from neuraminidase__InfluenzaA__AFN20035
augaaccccaaccagaagaucaucaccaucggcagcgugugcaugaccaucgggaucgccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84114 - RNA, 1410 nt, Artificial Sequence; identical to SEQ ID NO: 81265
  derived and/or modified sequence opt1 from neuraminidase__InfluenzaA__AFN20041

SEQ ID NO: 84115 - RNA, 1410 nt, Artificial Sequence; identical to SEQ ID NO: 81265
  derived and/or modified sequence opt1 from neuraminidase__InfluenzaA__AFN20047

SEQ ID NO: 84116 - RNA, 1410 nt, Artificial Sequence; identical to SEQ ID NO: 82088
  derived and/or modified sequence opt1 from neuraminidase__InfluenzaA__AFN20063

SEQ ID NO: 84117 - RNA, 1410 nt, Artificial Sequence
  derived and/or modified sequence opt1 from neuraminidase__InfluenzaA__AFN20077
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 84118 - RNA, 1410 nt, Artificial Sequence; identical to SEQ ID NO: 81265
  derived and/or modified sequence opt1 from neuraminidase__InfluenzaA__AFN20083

SEQ ID NO: 84119 - RNA, 1410 nt, Artificial Sequence
  derived and/or modified sequence opt1 from neuraminidase__InfluenzaA__AFN20094
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaucuacgagaacaacaccugggugaaccagaccuacgugaacaucagcaacaccaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggagccccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagagcgagugcgcgugcgugaacggguccugcuucacgaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaaggccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggacguccgggagcuccaucagcuucugcggcgucaacuccgacaccaugggguggagcuggcccgacggcgcggagcugccguucaccaucgacaaguga

SEQ ID NO: 84120 - RNA, 1410 nt, Artificial Sequence; identical to SEQ ID NO: 81724
  derived and/or modified sequence opt1 from neuraminidase__InfluenzaA__AFN20100

SEQ ID NO: 84121 - RNA, 1410 nt, Artificial Sequence
  derived and/or modified sequence opt1 from neuraminidase__InfluenzaA__AFN20114
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcucccccgugagcuccaacggcgccaacggggugaagggcuucagcuucaaguacgggaacggcgucuggaucgggcggaccaagagcaccuccagccgcaacggcuucgagaugaucugggaccccaacggcuggaccgggacggacaacuccuucagcaugaagcaggacaucgugggcaucaacgagugguccggguacagcggcuccuucgugcagcacccggagcugaccgggcuggacugcauccggcccugcuucugggucgagcucauccgcggccggcccaaggagaacaccguguggaccagcggcuccagcaucuccuucugcggggucaacagcgacacggugggcugguccuggcccgacggggccgagcugccguucaccaucgacaaguga

SEQ ID NO: 84122 - RNA, 1410 nt, Artificial Sequence
  derived and/or modified sequence opt1 from neuraminidase__InfluenzaA__AFN20128
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccauccgcuccuggcggaacaacauccugcgcacgcaggagagcgagugcgcgugcgugaacggguccugcuucaccaucaugaccgacggcccgagcgacggccaggccuccuacaagaucuuccggaucgagaaggggaagaucaucaagagcguggagaugaacgcccccaacuaccacuacgaggagugcuccugcuaccccgacagcuccgagaucacgugcgucugccgcgacaacuggcacggcagcaaccggcccuggguguccuucaaccagaaccucgaguaccagaucggguacaucugcagcggcaucuucggggacaacccgcgcuccaacgacaagaccggcagcugcggccccguguccagcaacggggccaacggcgucaagggguucagcuucaaguacggcaacgggguguggaucggccggaccaaguccaucagcucccgcaagggcuucgagaugaucugggaccccaacggguggaccggcaccgacaacaacuucagcaucaagcaggacaucguggggaucaacgagugguccggcuacagcggguccuucguccagcaccccgagcugacgggccuggacugcauccggccgugcuucuggguggagcucauccgcggccggcccaaggagaacaccaucuggaccagcggguccagcaucuccuucugcggcgugaacagcgacaccgucgggugguccuggcccgacggcgccgagcugcccuucacgaucgacaaguga

SEQ ID NO: 84123 - RNA, 1410 nt, Artificial Sequence; identical to SEQ ID NO: 81265
  derived and/or modified sequence opt1 from neuraminidase__InfluenzaA__AFN87935

SEQ ID NO: 84124 - RNA, 1410 nt, Artificial Sequence
  derived and/or modified sequence opt1 from neuraminidase__InfluenzaA__AFN87937
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaugaagcaggacaucguggggaucaacgaguggagcggcuacuccgggagcuucgugcagcacccggagcugaccggccuggacugcauccggcccugcuucugggucgagcucauccgcggccggcccaaggagaacaccguguggaccuccgggagcuccaucagcuucugcggcgucaacuccgacacggugggguggagcuggcccgacggcgccgagcugccguucaccaucgacaaguga

SEQ ID NO: 84125 - RNA, 1410 nt, Artificial Sequence
  derived and/or modified sequence opt1 from neuraminidase__InfluenzaA__AFN87940
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaucaagcaggacaucguggggaucaacgaguggagcggcuacuccgggagcuucgugcagcacccggagcugaccggccuggacugcauccggcccugcuucugggucgagcucauccgcggccggcccaaggagaacaccaucuggaccuccgggagcuccaucagcuucugcggcgugaacuccgacacggucggguggagcuggcccgacggcgccgagcugccguucaccaucgacaaguga

SEQ ID NO: 84126 - RNA, 1410 nt, Artificial Sequence; identical to SEQ ID NO: 77746
  derived and/or modified sequence opt1 from neuraminidase__InfluenzaA__AFN87942

SEQ ID NO: 84127 - RNA, 1410 nt, Artificial Sequence; identical to SEQ ID NO: 84124
  derived and/or modified sequence opt1 from neuraminidase__InfluenzaA__AFN87944

SEQ ID NO: 84128 - RNA, 1410 nt, Artificial Sequence
  derived and/or modified sequence opt1 from neuraminidase__InfluenzaA__AFN87946
augaaccccaaccagaagaucaucaccaucggcagcgugugcaugaccaucgggauggccaaccugacgcuccagaucggcaacaucaucuccaucuggaucagccacuccauccagcuggggaaccagaaccagaucgagaccugcaaccagagcgucaucaacuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucgucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgaggugaccugcgucugccgggacaacuggcacggcuccaaccgccccugggugagcuucaaccagaaccucgaguaccagaucggguacaucugcuccggcaucuucggggacaacccgcggcccaacgacaagacgggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 84129 - RNA, 1410 nt, Artificial Sequence
  derived and/or modified sequence opt1 from neuraminidase__InfluenzaA__AFN87948
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaccagcucccgcaacggcuucgagaugaucugggaccccaacggguggaccggcacggacaacagcuucuccaucaagcaggacaucguggggaucaacgaguggagcggcuacuccgggagcuucgugcagcacccggagcugaccggccuggacugcauccggcccugcuucugggucgagcucauccgcggccggcccaaggagaacaccaucuggaccuccgggagcuccaucagcuucugcggcgugaacuccgacaucgucggguggagcuggcccgacggcgccgagcugccguucacgaucgacaaguga

SEQ ID NO: 84130 - RNA, 1410 nt, Artificial Sequence
  derived and/or modified sequence opt1 from neuraminidase__InfluenzaA__AFN87950
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucaaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucaucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84131 - RNA, 1410 nt, Artificial Sequence; identical to SEQ ID NO: 81717
  derived and/or modified sequence opt1 from neuraminidase__InfluenzaA__AFN87952

SEQ ID NO: 84132 - RNA, 1410 nt, Artificial Sequence
  derived and/or modified sequence opt1 from neuraminidase__InfluenzaA__AFN87954
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 84133 - RNA, 1410 nt, Artificial Sequence
  derived and/or modified sequence opt1 from neuraminidase__InfluenzaA__AFN87956
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggucgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggacgaacgaguggagcggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaacuga

SEQ ID NO: 84134 - RNA, 1410 nt, Artificial Sequence
  derived and/or modified sequence opt1 from neuraminidase__InfluenzaA__AFN87958
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccgccuccagcaacggggccaacggcgugaagggguucuccuucaaguacggcaacgggguguggaucggccggaccaagagcaccagcucccgcaacggcuucgagaugaucugggaccccaacggguggaccggcacggacaacagcuucuccaugaagcaggacaucgucgggaucaacgaguggagcggcuacuccgggagcuucgugcagcacccggagcugaccggccuggacugcauccggcccugcuucuggguggagcucauccgcggccggcccaaggagaacaccgucuggaccuccgggagcuccaucagcuucugcggcgugaacuccgacacggucggguggagcuggcccgacggcgcggagcugccguucaccaucgacaaguga

SEQ ID NO: 84135 - RNA, 1410 nt, Artificial Sequence
  derived and/or modified sequence opt1 from neuraminidase__InfluenzaA__AFN87960
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggaucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84136 - RNA, 1413 nt, Artificial Sequence
  derived and/or modified sequence opt1 from neuraminidase__InfluenzaA__AFO64805
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccaacaacggcgccgccagcuacaagaucuucaagaucgagaaggggaaggucaccaaguccaucgagcucaacgcccccaacagccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcggggugaacagcgacaccgccaacugguccuggcccgacggcgccgagcugcccuucaccaucgacaaguga

SEQ ID NO: 84137 - RNA, 1413 nt, Artificial Sequence
  derived and/or modified sequence opt1 from neuraminidase__InfluenzaA__AFO64816
augaaccccaaccagaagaucaucaccaucggcagcaucugcauggccaucgggaucaucucccugauccuccagaucggcaacaucgugagcaucuggaucucccacagcauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacagcucccugugcccgaucagcggcugggccaucuacuccaaggacaacagcauccggaucggguccaagggcgacguguucgucauccgcgagcccuucaucagcugcucccaccucgagugccggaccuucuuccugacgcagggggcccugcucaacgacaagcacagcaacggcaccgugaaggaccgcucccccuaccgggcccugaugagcugccccaucggggaggcgccgucccccuacaacagccgcuucgagagcguggccugguccgccagcgccugccacgacggcaugggcuggcugaccaucgggaucuccggccccgacgacggggcggucgccgugcucaaguacaacggcaucaucaccgagacgaucaagagcuggcggcgccggauccugcgcacccaggaguccgagugcgugugcgucaacggcagcugcuucaccaucaugaccgacgggcccaacaacggcccggccuccuacaagaucuucaagaucgagaaggggaaggugaccaagagcaucgagcuggacgcccccaacucccacuacgaggagugcagcugcuaccccgacgccggcacggugaugugcgucugccgggacaacuggcacggguccaaccgccccugggugagcuucaaccagaaccucgacuaccagaucggcuacaucugcuccggcguguucggggacaacccgcggcccaaggacggcaaggggagcugcgaccccgucaccguggacggcgcggacggggugaagggcuucuccuaccgcuacggcaacggggucuggaucggccggaccaagagcaacuccagccgccggggguucgagaugaucugggaccccaacggcuggacggacaccgacuccaaguuccuggugaagcaggacguggucgccaugaccgacuggagcggguacagcggcuccuucgugcagcacccggagcugaccggccucgacugcaugcgccccugcuucugggucgagcugauccgggggcgcccccgggagaacacgaccaucuggaccagcggcuccagcaucuccuucugcggggugaacggcgacaccgccaacuggagcuggcccgacggcgccgagcugccguucacgaucgacaaguga

SEQ ID NO: 84138 - RNA, 1413 nt, Artificial Sequence
  derived and/or modified sequence opt1 from neuraminidase__InfluenzaA__AFO64827
augaaccccaaccagaagaucaucaccaucggcagcaucuccauggccaucgggaucaucagccugauccuccagaucggcaacaucaucuccaucugggugagccacuccauccagaccgggagccagaaccacacgggcaucugcaaccagcgcaucaucaccuacgagaacuccaccugggucaaccagaccuacgugaacaucaacaacacgaacgugaucgccgggaaggacaagaccagcgucacccuggcgggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggccccgagccccuacaacucccgguucgagagcguggcguggagcgccuccgccugccacgacggcaugggcuggcucaccaucgggaucagcggccccgacgacggggccguggcgguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuaccgcaucuucaagaucgagaaggggaaggucaccaagagcaucgagcucgacgccccgaacucccacuacgaggagugcagcugcuaccccgacaccggcaccgugaugugcgugugccgggacaacuggcacggguccaaccgccccugggucagcuucaaccagaaccuggacuaccagaucggcuacaucugcuccggcguguucggggacaacccccggccgaaggacggcaaggggagcugcgaccccgugacggucgacggcgccgacggggugaagggcuucuccuaccgcuacggcaacgggguguggaucggccggaccaagagcaaccgcuuccggaagggguucgagaugaucugggaccccaacggcuggaccgacaccgacuccgacuuccuggucaagcaggacgugguggcgaugacggacuggagcggguacuccggcagcuucguccagcaccccgagcucaccggccuggacugcaugcgcccgugcuucuggguggagcugguccgggggcgcccccgggagaacaccaccaucuggacgagcggcuccagcaucuccuucugcggggugaacagcgacaccgccaacugguccuggcccgacggcgccgagcuccccuucaccaucgacaaguga

SEQ ID NO: 84139 - RNA, 1413 nt, Artificial Sequence
  derived and/or modified sequence opt1 from neuraminidase__InfluenzaA__AFO64838
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuaccgcaucuucaagaucgagaaggggcgggucaccaagagcaucgagcucgacgccccgaacuaccacuacgaggagugcuccugcuaccccgacaccggcaccgugaugugcgugugccgcgacaacuggcacgggagcaaccggcccugggucuccuucaaccagaaccuggacuaccagaucggcuacaucugcagcggcguguucggggacaacccccgcccgaaggacggcgagggguccugcaaccccgugacggucgacggcgcggacggggugaagggcuucagcuaccgguacggcaacgggguguggaucggccgcaccaaguccaaccggcugcgcaagggguucgagaugaucugggaccccaacggcuggaccgacaccgacagcgacuucuccaugaagcaggacgucguggccaugacggacuggagcggguacuccggcagcuucgugcagcaccccgagcucaccggccuggacugcaugcggccgugcuucugggucgagcuggugcgcgggcucccccgggagaacaccaccaucuggacgagcggcuccagcaucuccuucugcggggucaacagcgacaccgccaacugguccuggcccgacggcgccgagcugcccuucaccaucgacaaguga

SEQ ID NO: 84140 - RNA, 1413 nt, Artificial Sequence
  derived and/or modified sequence opt1 from neuraminidase__InfluenzaA__AFO64849
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuaccggaucuucaagaucgagaaggggaagaucaccaagagcaucgagcucgacgccccgaacucccacuacgaggagugcagcugcuaccccgacaccggcaccgucaugugcgugugccgcgacaacuggcacggguccaaccggcccugggugagcuucaaccagaaccuggacuaccagaucggcuacaucugcuccggcgucuucggggacaacccccgcccgaaggacggcgaggggagcugcaaccccgugacgguggacggcgcggacggggucaagggcuucuccuaccgguacggcaacgggguguggaucggccgcaccaagagcaaccggcugcgcaagggguucgagaugaucugggaccccaacggcuggaccgacaccgacuccgacuucagcgugaagcaggacgucguggccaugacggacugguccggguacagcggcagcuucgugcagcaccccgagcucaccggccuggacugcaugcggccgugcuucugggucgagcuggugcgcgggcggccccgcgagaacgccaccaucuggaccuccggcagcuccaucagcuucugcggggucaacuccgacacggccaacuggagcuggcccgacggcgccgagcuccccuucaccaucgacaaguga

SEQ ID NO: 84141 - RNA, 1413 nt, Artificial Sequence; identical to SEQ ID NO: 75976
  derived and/or modified sequence opt1 from neuraminidase__InfluenzaA__AFO64860

SEQ ID NO: 84142 - RNA, 1413 nt, Artificial Sequence
  derived and/or modified sequence opt1 from neuraminidase__InfluenzaA__AFO64871
augaaccccaaccagaagaucaucaccaucggcagcaucuccaucgccaucgggaucaucagccugauccuccagaucggcaacaucaucuccaucugggccagccacuccauccagaccgggagccagaaccacacgggcgugugcaaccagcgcaucaucaccuacgagaacuccaccugggucaaccagaccuacgugaacaucaacaacacgaacguggucgcggggaaggacaagaccagcaugacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggccucggcuggcugaccaucgggaucagcggccccgacaacggggcgguggccguccugaaguacaacggcaucaucacggagaccaucaaguccuggaagaagcgcauccuccggacccaggagagcgagugcgugugcaugaacggcuccugcuucaccaucaugacggacgggcccagcaacggcgccgccuccuaccgcaucuucaagaucgagaaggggcgggugaccaagagcaucgagcuggacgccccgaacuaccacuacgaggagugcuccugcuaccccgacaccggcaccgucaugugcgugugccgcgacaacuggcacgggagcaaccggcccuggguguccuucaaccagaaccuggacuaccagaucggcuacaucugcagcggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacagcgacuucuccaugcggcaggacaucguggccaugacggacuggagcggguacuccggcagcuucguccagcaccccgagcugaccggccuggacugcaugcgcccgugcuucuggguggagcucgugcgggggcugccccgcgagaacaccaccaucuggacgagcggcuccagcaucuccuucugcggggucaacagcgacaccgccaacugguccuggcccgacggcgccgagcugcccuucaccaucgacaaguga

SEQ ID NO: 84143 - RNA, 1413 nt, Artificial Sequence
  derived and/or modified sequence opt1 from neuraminidase__InfluenzaA__AFO64882
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcgcccgcgggagaacaccaccaucuggacguccggcagcuccaucagcuucugcggggugaacuccgacaccgccaacuggagcuggcccgacggcgccgagcuccccuucaccaucgacaaguga

SEQ ID NO: 84144 - RNA, 1413 nt, Artificial Sequence
  derived and/or modified sequence opt1 from neuraminidase__InfluenzaA__AFO64893
augaaccccaaccagaagaucaucaccaucggcagcaucuccguggccaucgggaucaucagccugaugcuccagaucggcaacaucaucuccaucugggccagccacuccauccagaccgggagccagaaccacacgggcaucugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccagcgacggcgccgccuccuacaagaucuucaagaucgagaaggggaaggugaccaagagcaucgagcucaacgcccccaacucccacuacgaggagugcagcugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcgaggggagcugcaacccggucacgguggacggcgcggacggggugaagggcuucuccuacaaguacggcaacggggucuggaucggccggaccaagagcaaccgcuuccggaagggguucgagaugaucugggaccccaacggcuggaccgacaccgacuccgacuucagcgugaagcaggacguggucgccaucacggacuggagcggguacuccggcagcuucgugcagcaccccgagcugaccggccucgacugcauccgccccugcuucugggucgagcuggugcgggggcgcccgcgggagaacaccaccaucuggacguccggcagcuccaucagcuucugcggggugaacuccgacaccgccaacuggagcuggcccgacggcgccgagcugcccuucaccaucgacaaguga

SEQ ID NO: 84145 - RNA, 1413 nt, Artificial Sequence
  derived and/or modified sequence opt1 from neuraminidase__InfluenzaA__AFO64904
augaaccccaaccagaagaucaucaccaucggcagcaucuccguggccaucgggaucaucagccugauccuccagaucggcaacaucaucuccaugugggccagccacuccauccagaccgggagccagaacuacacgggcaucugcaaccagcgcaucaucaccuacgagaacaacaccugggucaaccagaccuacgugaacaucaacaacacgaacguggucgcggggaaggacaagaucuccaugacccuggccggcaacagcucccugugcccgauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccgucaaggaccggucccccuaccgcgcccugaugagcugcccccugggggaggcgccgucccccuacaacagccgguucgaguccguggccuggagcgccagcgccugccacgacggccucggcuggcugaccaucgggaucuccggccccgacaacggggcgguggccguccugaaguacaacggcaucaucaccgagacgaucaagagcuggaagaagcagauccuccgcacccaggaguccgagugcgugugcgugaacggcagcugcuucaccaucaugaccgacgggcccuccaaccgggccgccagcuaccgcaucuucaagaucgagaagggccgggucacgaaguccaucgagcuggacgccccgaacuaccacuacgaggagugcagcugcuaccccgacaccgggaccgugaugugcgugugccgcgacaacuggcacggcuccaaccggcccugggucagcuucaaccagaaccuggacuaccagaucggguacaucugcuccggcguguucggcgacaacccccgcccgaaggacggggagggcagcugcaaccccgugaccgucgacggggcggacggcgugaagggguucuccuacaaguacggcaacggcguguggaucgggcggaccaagagcaaccgccuccggaagggcuucgagaugaucugggaccccaacggguggacggacaccgacuccgacuucagcaugaagcaggacgucguggccaugaccgacugguccggcuacagcggguccuucgugcagcaccccgagcugacgggccuggacugcaugcgcccgugcuucugggucgagcucgugcggggccugccccgcgagaacaccaccaucuggaccagcgggagcuccaucagcuucugcggcgucaacuccgagacggccaacuggagcuggcccgacggggccgagcugcccuucaccaucgacaaguga

SEQ ID NO: 84146 - RNA, 1413 nt, Artificial Sequence
  derived and/or modified sequence opt1 from neuraminidase__InfluenzaA__AFO65019
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacucccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggagcugcaacccggugacggcggacggcgccgacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggagcggguacuccggcagcuucgugcagcaccccgagcucaccggccuggacugcauccgccccugcuucugggucgagcuggugcgggggcgcccgcgggagaacaccaccaucuggacguccggcagcuccaucagcuucugcggggucaacuccgacaccgccaacuggagcuggcccgacggcgccgagcuccccuucaccaucgacaaguga

SEQ ID NO: 84147 - RNA, 1413 nt, Artificial Sequence; identical to SEQ ID NO: 77461
  derived and/or modified sequence opt1 from neuraminidase__InfluenzaA__AFO65030

SEQ ID NO: 84148 - RNA, 1413 nt, Artificial Sequence
  derived and/or modified sequence opt1 from neuraminidase__InfluenzaA__AFO65041
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacguggucgcggggaaggacaagaccagcgugacccuggccggcaacuccagccugugcuccaucagcggcugggccaucuacaccaaggacaacuccauccggaucgggagcaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagagcgagugcgugugcgucaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcagcggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggugaacagcgacaccgccaacugguccuggcccgacggcgccgagcugcccuucaccaucgacaaguga

SEQ ID NO: 84149 - RNA, 1413 nt, Artificial Sequence
  derived and/or modified sequence opt1 from neuraminidase__InfluenzaA__AFO65052
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcaugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugcaacgacggcaugggcuggcucaccaucgggaucagcggccccgacaacggggcgguggccgugcugaaguacaacggcaucaucacggagaccaucaaguccuggaagaagcagauccugcgcacccaggagagcgagugcgucugcgugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 84150 - RNA, 1413 nt, Artificial Sequence; identical to SEQ ID NO: 75836
  derived and/or modified sequence opt1 from neuraminidase__InfluenzaA__AFO66139

SEQ ID NO: 84151 - RNA, 1413 nt, Artificial Sequence
  derived and/or modified sequence opt1 from neuraminidase__InfluenzaA__AFO66150
augaaccccaaccagaagaucaucaccaucggcagcaucuccguggccaucgggaucaucagccugauccuccagaucggcaacaucaucuccaucugggccagccacuccauccagaccgggagccagaacuacacgggcaucugcaaccagcgcaucaucaccuacgagaaccggaccugggucaaccagaccuacgugaacaucaacaacacgaacguggucgcggggaaggacaagaccuccaugacccuggccggcaacagcucccugugcccgauccgcggcugggccaucuacaccaaggacaacagcauccggaucggguccaagggcgacguguucgugauccgcgagcccuucaucagcugcucccaccucgagugccggacguucuuccugacccagggggcccugcucaacgacaagcacagcaacggcaccaucaaggaccgcucccccuuccgggcccugaugagcugcccccugggggaggcgccgucccccuacaacagccgcuucgaguccgucgccuggagcgccagcgccugccacgacggccucggcuggcugaccaucgggaucuccggccccgacaacggggcgguggccgugcugaaguacaacggcaucaucacggagaccaucaagagcuggaagaagcagauccuccggacccaggaguccgagugcgucugcgugaacggcagcugcuucaccaucaugacggacgggcccuccaaccgcgccgccagcuaccggaucuucaagaucgagaagggccgcgugaccaaguccaucgagcuggacgccccgaacuaccacuacgaggagugcagcugcuaccccgacaccgggaccgucaugugcgugugccgggacaacuggcacggcuccaaccgccccugggugagcuucaaccagaaccuggacuaccagaucggguacaucugcuccggcgucuucggcgacaacccccggccgaaggacggggagggcagcugcaaccccgugacgguggacggggcggacggcgucaagggguucuccuaccgcuacggcaacggcguguggaucgggcggaccaagagcaaccgcauccggaagggcuucgagaugaucugggaccccaacggguggaccgacaccgacuccgacuucagcaugaagcaggacguggucgccaugacggacugguccggcuacagcggguccuucgugcagcaccccgagcucaccggccuggacugcaugcgcccgugcuucuggguggagcugguccggggccucccccgcgagaacaccaccaucuggacgagcgggagcuccaucagcuucugcggcgugaacuccgagaccgccaacuggagcuggcccgacggggccgagcugcccuucaccaucgacaaguga

SEQ ID NO: 84152 - RNA, 1413 nt, Artificial Sequence
  derived and/or modified sequence opt1 from neuraminidase__InfluenzaA__AFO66161
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaucugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgagcggcuccagcaucuccuucugcggggugaacagcgacaccgccaacugguccuggcccgacggcgccgagcugcccuucaccaucgacaaguga

SEQ ID NO: 84153 - RNA, 1413 nt, Artificial Sequence
  derived and/or modified sequence opt1 from neuraminidase__InfluenzaA__AFO66172
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcaugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 84154 - RNA, 1413 nt, Artificial Sequence; identical to SEQ ID NO: 75938
  derived and/or modified sequence opt1 from neuraminidase__InfluenzaA__AFO66183

SEQ ID NO: 84155 - RNA, 1413 nt, Artificial Sequence
  derived and/or modified sequence opt1 from neuraminidase__InfluenzaA__AFO66194
augaaccccaaccagaagaucaucaccaucggcagcaucuccaucgccaucgggaucaucagccugaugcuccagaucggcaacaucaucuccaucugggccagccacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcagcggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacaucguggccaucacggacuggagcggguacagcggcuccuucgugcagcaccccgagcucaccggccuggacugcauccggcccugcuucugggucgagcuggugcgcgggcucccgaaggagaacaccaccaucuggacgagcggcuccagcaucuccuucugcggggucaacagcgacaccgccaacugguccuggcccgacggcgccgagcugcccuucaccaucgacaaguga

SEQ ID NO: 84156 - RNA, 1410 nt, Artificial Sequence; identical to SEQ ID NO: 77563
  derived and/or modified sequence opt1 from neuraminidase__InfluenzaA__AFO66205

SEQ ID NO: 84157 - RNA, 1413 nt, Artificial Sequence; identical to SEQ ID NO: 75423
  derived and/or modified sequence opt1 from neuraminidase__InfluenzaA__AFO66216

SEQ ID NO: 84158 - RNA, 1413 nt, Artificial Sequence; identical to SEQ ID NO: 75394
  derived and/or modified sequence opt1 from neuraminidase__InfluenzaA__AFO66227

SEQ ID NO: 84159 - RNA, 1413 nt, Artificial Sequence
  derived and/or modified sequence opt1 from neuraminidase__InfluenzaA__AFO66238
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagagcgagugcgugugcaugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcagcggcgucuucggggacaacccccggcccaaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 84160 - RNA, 1413 nt, Artificial Sequence
  derived and/or modified sequence opt1 from neuraminidase__InfluenzaA__AFO66249
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaccgucaugugcgugugccgggacaacuggcacggcagcaaccgccccuggguguccuucaaccagaaccuggacuaccagaucggcuacaucugcagcggggucuucggcgacaacccccggcccaaggacggggagggcuccugcaacccggugacgguggacggggcggacggcgucaagggcuucagcuacaaguacgggaacggcguguggaucgggcgcaccaaguccaaccggcugcgcaagggcuucgagaugaucugggaccccaacggguggaccaacaccgacagcgacuucuccgugaagcaggacgucguggccaucacggacuggagcggcuacagcggcuccuucgugcagcaccccgagcucaccgggcuggacugcauccggcccugcuucugggucgagcuggugcgcggccucccgcgggagaacaccaccaucuggacgagcggguccagcaucuccuucugcggcgucaacagcgacaccgccaacugguccuggcccgacggcgccgagcugcccuucaccaucgacaaguga

SEQ ID NO: 84161 - RNA, 1413 nt, Artificial Sequence
  derived and/or modified sequence opt1 from neuraminidase__InfluenzaA__AFP33330
augaaccccaaccagaagaucaucaccaucggcagcaucuccguggccaucgggaucaucagccugauccuccagaucggcaacaucaucuccaucugggccagccacuccauccaggcggggagccagaacuacaccggcaucugcaaccagaagaucaucacguacgagaaccgcaccugggucaaccagaccuacgugaacaucaacaacaccaacguggucgccgggaaggacaagacguccaugacccuggccggcaacagcucccugugcccgauccggggcugggccaucuacaccaaggacaacagcauccgcaucggguccaagggcgacguguucgugauccgggagcccuucaucagcugcucccaccucgagugccgcaccuucuuccugacgcagggggcccugcucaacgacaagcacagcaacggcaccaucaaggaccggucccccuuccgcgcgcugaugagcugcccccugggggaggccccgucccccuacaacagccgguucgaguccgucgccuggagcgccagcgcgugccacgacggccucggcuggcugaccaucgggaucuccggccccgacaacggggccguggccgugcugaaguacaacggcaucaucaccgagacgaucaagagcuggaagaagcagauccuccgcacccaggaguccgagugcgucugcgugaacggcagcugcuucaccaucaugaccgacgggcccuccaaccgggccgccagcuaccgcaucuucaagaucgagaagggccgggugacgaaguccaucgagcuggacgcgccgaacuaccacuacgaggagugcagcugcuaccccgacaccgggaccgucaugugcgugugccgcgacaacuggcacggcuccaaccggcccugggugagcuucaaccagaaccuggacuaccagaucggguacaucugcuccggcgucuucggcgacaacccccgcccgaaggacggggagggcagcugcaaccccgugaccguggacggggccgacggcgucaagggguucuccuaccgguacggcaacggcguguggaucgggcgcaccaagagcaaccggcuccgcaagggcuucgagaugaucugggaccccaacggguggacggacaccgacuccgacuucagcaugaagcaggacguggucgccaugaccgacugguccggcuacagcggguccuucgugcagcaccccgagcugacgggccuggacugcaugcggccgugcuucuggguggagcucguccgcggccugccccgggagaacaccaccaucuggaccagcgggagcuccaucagcuucugcggcgugaacuccgagacggccaacuggagcuggcccgacggggccgagcugcccuucaccaucgacaaguga

SEQ ID NO: 84162 - RNA, 1413 nt, Artificial Sequence
  derived and/or modified sequence opt1 from neuraminidase__InfluenzaA__AFP33331
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugaucgcggggaaggacaagaccagcgugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcgcauccugcggacccaggagagcgagugcgucugcgugaacggcuccugcuucaccaucaugacggacgggcccagcaacggcgccgccuccuacaagaucuucaagaucgagaaggggaaggugaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcagcggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccgccccugcuucugggucgagcuggugcgggggcucccgcgcgagaacaccaccaucuggacgagcggcuccagcaucuccuucugcggggucaacagcgacaccgccaacugguccuggcccgacggcgccgagcugcccuucaccaucgacaaguga

SEQ ID NO: 84163 - RNA, 1410 nt, Artificial Sequence; identical to SEQ ID NO: 82151
  derived and/or modified sequence opt1 from neuraminidase__InfluenzaA__AFQ32576

SEQ ID NO: 84164 - RNA, 1410 nt, Artificial Sequence
  derived and/or modified sequence opt1 from neuraminidase__InfluenzaA__AFQ37282
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccgggggcagcuccaucagcuucugcggggugaacuccgacaccgucggcuggagcuggcccgacggcgccgagcugccguucacgaucgacaaguga

SEQ ID NO: 84165 - RNA, 1410 nt, Artificial Sequence
  derived and/or modified sequence opt1 from neuraminidase__InfluenzaA__AFQ55691
augaaccccaaccagaagaucaucaccaucggcguggucaacaccacgcugagcaccaucgcccuccugaucggggugggcaaccugguguucaacaccgucauccacgagaagaucggggaccaccagaccgugacgcacccgaccaccaccacgcccgccauccccaacugcuccgacaccaucaucaccuacaacaacaccaucaucaacaacaucacgaccaccaucaucaccgaggcggagcgccccuucaagagcccgcucccccugugccccuuccggggcuucuuccccuuccacaaggacaacgccauccgccugggggagaacaaggacgugaucgucacgcgggagccguacguguccugcgacaacgacaacugcuggagcuucgcccucgcccagggcgcccugcugggcaccaagcacuccaacgggaccaucaaggaccgcacccccuaccggagccucauccgcuuccccaucggcacggcgcccgugcuggggaacuacaaggagaucugcaucgccugguccagcuccagcugcuucgacggcaaggaguggaugcacgucugcaugaccgggaacgacaacgacgccuccgcccagaucaucuacgcgggcaagaugaccgacagcaucaaguccuggcggaaggacauccugcgcacccaggagagcgagugccagugcaucgacggcacgugcgugguggccgucaccgacgggccggccgccuccagcgccgaccaccggaucuacuggauccgcgagggcaagaucaucaaguacgaggacgugcccaagaccaagauccagcaccucgaggagugcuccugcuacguggacgucgacguguacugcaucugccgggacaacuggaaggggagcaaccgccccuggaugcggaucaacaacgagaccauccuggagacgggcuacgugugcuccaaguuccacagcgacacgccccgcccggcggaccccagcaccgucuccugcgacagccccuccaacgugaacggcgggcccggcgugaagggguucggcuucaaggccgggaacgacgucuggcugggccggaccgugagcaccuccggccgcagcggguucgagaucaucaaggugaccgagggcuggaucaacuccccgaaccacgccaagagcaucacccagacccucauguccaacaacgacuggagcggguacuccggcagcuucaucaucaagacgaaggacugcuuccagcccugcuucuacgucgagcugauccgggggcgccccaacaagaacgacgacguguccuggaccagcaacuccaucgucaccuucugcggccuggacaacgagcccggcagcgggaacuggccggacggcuccaacaucggguucaugcccaaguga

SEQ ID NO: 84166 - RNA, 1410 nt, Artificial Sequence
  derived and/or modified sequence opt1 from neuraminidase__InfluenzaA__AFR68156
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 84167 - RNA, 1410 nt, Artificial Sequence; identical to SEQ ID NO: 84166
  derived and/or modified sequence opt1 from neuraminidase__InfluenzaA__AFR68166

SEQ ID NO: 84168 - RNA, 1410 nt, Artificial Sequence
  derived and/or modified sequence opt1 from neuraminidase__InfluenzaA__AFR68176
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggccagcugguccaaggacauccugcgcacccaggagagcgagugcgucugcaucaacggcacgugcgccguggugaugaccgacggguccgcgagcggcaaggccgacaccaagauccucuucaucaaggagggcaagaucguccacaccagcacgcuguccgggagcgcccagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggagcaaccccaaguccaagcugcagaucaaccgccaggucaucguggaccgggggaaccgcagcggcuacuccgggaucuucagcguggagggcaagaacugcaucaaccggugcuucuacgucgagcucauccgcggccggaaggaggagaccgaggugcuguggaccuccaacagcaucguggucuucugcgggaccagcggcacguacgggaccggcuccuggccggacggggccgaccugaaccucaugcccaucuga

SEQ ID NO: 84169 - RNA, 1410 nt, Artificial Sequence; identical to SEQ ID NO: 77746
  derived and/or modified sequence opt1 from neuraminidase__InfluenzaA__AFR84677

SEQ ID NO: 84170 - RNA, 1410 nt, Artificial Sequence; identical to SEQ ID NO: 78633
  derived and/or modified sequence opt1 from neuraminidase__InfluenzaA__AFR84687

SEQ ID NO: 84171 - RNA, 1410 nt, Artificial Sequence; identical to SEQ ID NO: 77736
  derived and/or modified sequence opt1 from neuraminidase__InfluenzaA__AFR84696

SEQ ID NO: 84172 - RNA, 1410 nt, Artificial Sequence; identical to SEQ ID NO: 77746
  derived and/or modified sequence opt1 from neuraminidase__InfluenzaA__AFR84706

SEQ ID NO: 84173 - RNA, 1410 nt, Artificial Sequence; identical to SEQ ID NO: 77736
  derived and/or modified sequence opt1 from neuraminidase__InfluenzaA__AFR84716

SEQ ID NO: 84174 - RNA, 1410 nt, Artificial Sequence; identical to SEQ ID NO: 77736
  derived and/or modified sequence opt1 from neuraminidase__InfluenzaA__AFR84726

SEQ ID NO: 84175 - RNA, 1410 nt, Artificial Sequence; identical to SEQ ID NO: 77736
  derived and/or modified sequence opt1 from neuraminidase__InfluenzaA__AFR84736

SEQ ID NO: 84176 - RNA, 1410 nt, Artificial Sequence; identical to SEQ ID NO: 77736
  derived and/or modified sequence opt1 from neuraminidase__InfluenzaA__AFR84746

SEQ ID NO: 84177 - RNA, 1410 nt, Artificial Sequence; identical to SEQ ID NO: 77736
  derived and/or modified sequence opt1 from neuraminidase__InfluenzaA__AFR84756

SEQ ID NO: 84178 - RNA, 1410 nt, Artificial Sequence; identical to SEQ ID NO: 77736
  derived and/or modified sequence opt1 from neuraminidase__InfluenzaA__AFR84766

SEQ ID NO: 84179 - RNA, 1410 nt, Artificial Sequence; identical to SEQ ID NO: 77736
  derived and/or modified sequence opt1 from neuraminidase__InfluenzaA__AFR84776

SEQ ID NO: 84180 - RNA, 1410 nt, Artificial Sequence; identical to SEQ ID NO: 77736
  derived and/or modified sequence opt1 from neuraminidase__InfluenzaA__AFR84786

SEQ ID NO: 84181 - RNA, 1410 nt, Artificial Sequence; identical to SEQ ID NO: 77736
  derived and/or modified sequence opt1 from neuraminidase__InfluenzaA__AFR84796

SEQ ID NO: 84182 - RNA, 1410 nt, Artificial Sequence; identical to SEQ ID NO: 77746
  derived and/or modified sequence opt1 from neuraminidase__InfluenzaA__AFR84806

SEQ ID NO: 84183 - RNA, 1410 nt, Artificial Sequence; identical to SEQ ID NO: 77736
  derived and/or modified sequence opt1 from neuraminidase__InfluenzaA__AFR84816

SEQ ID NO: 84184 - RNA, 1410 nt, Artificial Sequence; identical to SEQ ID NO: 77746
  derived and/or modified sequence opt1 from neuraminidase__InfluenzaA__AFR84826

SEQ ID NO: 84185 - RNA, 1410 nt, Artificial Sequence
  derived and/or modified sequence opt1 from neuraminidase__InfluenzaA__AFR84836
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggaggugcccagccccuacaacucccgguucgagagcguggccuggagcgcguccgccugccacgacggcaucaacuggcucaccaucggcaucagcgggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgagaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84186 - RNA, 1410 nt, Artificial Sequence; identical to SEQ ID NO: 78550
  derived and/or modified sequence opt1 from neuraminidase__InfluenzaA__AFR84846

SEQ ID NO: 84187 - RNA, 1410 nt, Artificial Sequence; identical to SEQ ID NO: 77746
  derived and/or modified sequence opt1 from neuraminidase__InfluenzaA__AFR84856

SEQ ID NO: 84188 - RNA, 1410 nt, Artificial Sequence
  derived and/or modified sequence opt1 from neuraminidase__InfluenzaA__AFR84866
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuuccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84189 - RNA, 1410 nt, Artificial Sequence; identical to SEQ ID NO: 78454
  derived and/or modified sequence opt1 from neuraminidase__InfluenzaA__AFR84876

SEQ ID NO: 84190 - RNA, 1410 nt, Artificial Sequence; identical to SEQ ID NO: 78550
  derived and/or modified sequence opt1 from neuraminidase__InfluenzaA__AFR84895

SEQ ID NO: 84191 - RNA, 1410 nt, Artificial Sequence; identical to SEQ ID NO: 78550
  derived and/or modified sequence opt1 from neuraminidase__InfluenzaA__AFR84905

SEQ ID NO: 84192 - RNA, 1410 nt, Artificial Sequence; identical to SEQ ID NO: 78550
  derived and/or modified sequence opt1 from neuraminidase__InfluenzaA__AFR84915

SEQ ID NO: 84193 - RNA, 1410 nt, Artificial Sequence; identical to SEQ ID NO: 78550
  derived and/or modified sequence opt1 from neuraminidase__InfluenzaA__AFR84925

SEQ ID NO: 84194 - RNA, 1353 nt, Artificial Sequence
  derived and/or modified sequence opt1 from neuraminidase__InfluenzaA__AFU83119
augaaccccaaccagaagaucaucaccaucggcagcgugucccugaccaucgccacggucugcuuccucaugcagaucgccauccuggcgaccaccgugacccugcacuucaagcagaacgagugcagcaucccguccagcaaccaggugguccccugcgagcccaucaucguggagcgcaacgugacggaguaccgggacugguccaagccccagugccagaucaccggguucgccccguucagcaaggacaacuccauccgccucagcgccggcggggacaucugggucacccgggagcccuacguguccugcagccccgacaagugcuaccaguucgcccugggccaggggaccacgcuggacaacaagcacuccaacggcaccauccacgaccgcaucccccaccggacccuccugaugaacgagcugggcgugccguuccaccucgggaccaagcaggucugcaucgccuggagcuccagcuccugccacgacggccgcgcguggcugcacgugugcgugacgggggacgaccggaacgccaccgccagcuucaucuacgacggcguccugguggacuccaucgggagcuggucccagaacauccuccgcacccaggagagcgagugcgugugcaucaacgggaccugcacggucgugaugaccgacggcagcgccuccggccgggcggacacccgcauccuguucaucaaggagggcaagaucgugcacgucagcccccuguccgggagcgcccagcacaucgaggagugcuccugcuacccccgguaccccgacgugcgcugcgugugccgggacaacuggaagggcagcaaccgcccgaucaucgacaucuccauggccgacuacggcaucgacagcuccuacgucugcagcgggcucgugggcgacacgccccggaacgacgacuccagcuccaacagcaacugcaaggaccccaacaacgagcgcgggaaccccggcgugaaggggugggccuucgacuacggcaacgacgucuggaugggccggaccaucuccaaggacagccgcuccggguacgagaccuuccgggugaucggcggguggaccaucgccaacagcaagucccaggucaaccgccaggugaucguggacaacaacaacuggagcggcuacagcgggaucuucuccgucgagggcaagagcugcaucaaccggugcuucuacguggagcugauccgcggccgcccgcaggagacccgggugugguggacguccaacagcaucgucgcguucugcgggaccuccggcaccuacgggaccggcagcuggcccgacggggccaacaucaacuucaugcccaucuga

SEQ ID NO: 84195 - RNA, 1410 nt, Artificial Sequence
  derived and/or modified sequence opt1 from neuraminidase__InfluenzaA__AFV53208
augaaccccaaccagaagaucaucaccaucggcagcgugucccugaccaucgccacggucugcuuccucauccagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcaucaccggggacgacaagaacgccaccgccagcuucaucuacgacggccggcucauggacuccaucgggagcuggucccagaacauccugcgcacgcaggagagcgagugcgucugcaucaacgggaccugcaccguggugaugaccgacggcuccgccagcggccgggcggacacgcgcauccuguucaucgaggagggcaagaucguccacaucagcccccucuccgggagcgcccagcacguggaggagugcuccugcuacccccgguacccgggcgugcgcugcaucugccgggacaacuggaagggcagcaaccgccccgucaucgacaucaacauggaggacuacuccaucgacagcuccuacgugugcagcgggcuggugggcgacacgccccggaacgacgaccgcuccagcaacuccaacugccggaaccccaacaacgagcgcgggaaccagggcgucaaggggugggccuucgacaacggcgacgacguguggaugggccggaccaucagcaaggaccugcgcuccggguacgagaccuucaaggugaucggcggguggagcaccccgaacuccaagagccagaucaaccggcaggucaucguggacuccgacaaccgcagcggcuacuccgggaucuucagcgucgagggcaagagcugcaucaaccgcugcuucuacguggagcucauccggggccgcaagcaggagacccgggugugguggaccuccaacagcaucgucguguucugcgggaccuccggcacguacgggaccggcagcuggcccgacggggccaacaucaacuucaugcccaucuga

SEQ ID NO: 84196 - RNA, 1410 nt, Artificial Sequence
  derived and/or modified sequence opt1 from neuraminidase__InfluenzaA__AFV53219
augaaccccaaccagaagaccaucaccaucggcagcgugucccugacgaucgccaccgucugcuuccucaugcagaucgccauccuggcgaccaccgugacgcugcacuucaagcagcacgagugcgacagcccggccuccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacagcauccgccuguccgccggcggggacaucugggucacccgggagcccuacgugagcugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggcguggagcuccagcuccugccacgacgggaaggccuggcugcacgugugcgucaccggcgacgaccgcaacgccacggccagcuucaucuacgacgggcggcucguggacuccaucggcagcuggucccagaacauccugcgcacccaggagagcgagugcgugugcaucaacgggaccugcaccgucgugaugacggacggcuccgcgagcggccgggccgacacccgcauccuguucaucaaggaggggaagaucgugcacaucagcccccucuccggcagcgcccagcacaucgaggagugcuccugcuacccccgguacccggacguccgcugcaucugccgggacaacuggaagggcagcaaccgccccgugaucgacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggagucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggacguccggcaccuacgggaccggcagcuggcccgacggggccaacaucaacuucaugccgaucuga

SEQ ID NO: 84197 - RNA, 1410 nt, Artificial Sequence
  derived and/or modified sequence opt1 from neuraminidase__InfluenzaA__AFV53230
augaaccccaaccagaagaucaucaccaucggcagcgugucccugaccaucgccacggucugcuuccucaugcagaucgccauccuggugaccaccgugacccugcacuucaagcagcacgagugcgacagcccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugcaagaucaccggguucgcccccuucuccaaggacaacagcauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccagcuccugccacgacggcaaggcguggcugcacgugugcgucaccggggacgacaagaacgccaccgccagcuucaucuacgacggccggcucguggacuccaucgggagcuggucccagaacauccugcgcacgcaggagagcgagugcgugugcaucaacgggaccugcaccgucgugaugaccgacggcuccgccagcggccgggcggacacgaagauccuguucaucgaggagggcaagaucgugcacaucagcccccucuccgggagcgcccagcacgucgaggagugcuccugcuacccccgcuacccggacgugcggugcaucugccgcgacaacuggaagggcagcaaccggcccguggucgacaucuccauggaggacuacagcaucgacuccagcuacgugugcuccggccuggugggggacacgccccgcaacgacgaccggagcuccaacagcaacugccgcaaccccaacaacgagcggggcaaccagggggucaagggcugggccuucgacaacggggacgacguguggaugggccgcaccaucuccaaggaccugcggagcggcuacgagaccuucaaggucaucgggggcugguccaccccgaacagcaagucccagaucaaccgccaggugaucguggacagcgacaaccgguccggguacagcggcaucuucagcgucgaggggaaguccugcaucaaccgcugcuucuacguggagcucauccgcggccggaagcaggagacccgcgugugguggaccagcaacuccaucgucguguucugcggcaccagcgggacguacggcaccggguccuggcccgacggcgccaacaucaaccugaugcccaucuga

SEQ ID NO: 84198 - RNA, 1410 nt, Artificial Sequence; identical to SEQ ID NO: 77413
  derived and/or modified sequence opt1 from neuraminidase__InfluenzaA__AFV53241

SEQ ID NO: 84199 - RNA, 1410 nt, Artificial Sequence; identical to SEQ ID NO: 75099
  derived and/or modified sequence opt1 from neuraminidase__InfluenzaA__AFV53252

SEQ ID NO: 84200 - RNA, 1413 nt, Artificial Sequence
  derived and/or modified sequence opt1 from neuraminidase__InfluenzaA__AFV53263
augaaccccaaccagaagaucaucaccaucggcagcaucugcauggccaucgggaccaucucccugauccuccagaucggcaacaucaucagcaucuggaucucccacagcauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacagcucccugugcccgauccggggcugggccaucuacagcaaggacaacuccauccgcaucgggagcaagggcgacgucuucgugauccgggagcccuucaucuccugcagccaccucgagugccgcacguucuuccugacccagggggcccugcucaacgacaagcacuccaacggcaccgugaaggaccggagccccuaccgcgcccugauguccugccccaucggggaggccccgagccccuacaacucccgguucgagagcgucgcguggagcgccuccgccugccacgacggcaugggcuggcugaccaucgggaucagcggccccgacgacggggccguggcggugcucaaguacaacggcaucaucacggagaucaucaaguccuggcgcaagcagauccugcggacccaggagagcgagugcgucugcgugaacggcuccugcuucaccaucaugaccgacgggcccagcaaccgcccggccuccuaccggaucuucaagaucgagaagggcaagaucaccaagagcaucgagcuggacgcccccaacucccacuacgaggagugcagcugcuaccccgacacggggaaggugaugugcgucugccgcgacaacuggcacggcuccaaccggcccugggugagcuucaaccagaaccucgacuaccagaucggguacaucugcuccggcguguucggcgacaacccgcgccccaaggacgggaagggcagcugcgaccccgucaacguggacggggccgacggcgugaagggguucuccuaccgguacggcaacggcgucuggaucgggcgcaccaagagcaacuccagccggaagggcuucgagaugaucugggaccccaacggguggaccaacacggacggcaacuucuccgugaagcaggacguggucgccaugaccgacuggagcggguacagcggcuccuucgugcagcacccggagcugaccggccuggacugcauccgccccugcuucuggguggagcucauccgggggcgcccccgggaggagaccacgaucuggaccagcggcuccagcaucuccuucugcggggucaacagcgacaccgugaacugguccuggcccgacggcgcggagcugccguucaccaucgacaaguga

SEQ ID NO: 84201 - RNA, 1410 nt, Artificial Sequence
  derived and/or modified sequence opt1 from neuraminidase__InfluenzaA__AFV53274
augaaccccaaccagaagaucaucaccaucggcagcgugucccugaucaucgccaccgucugcuuccucaugcagaucgccauccuggugacgaccgugacccugcacuucaagcagcacgagugcgacagcccggcguccaaccaggucaugcccugcgagcccaucaucaucgagcgcaacaucaccgagaucguguaccucaacaacacgaccaucgagaaggagaucugccccaagguggucgaguaccggaacuggagcaagccgcagugccagaucaccggguucgcccccuucuccaaggacaacagcauccgccuguccgccggcggggacaucugggugacccgggagcccuacgugagcugcgaccccggcaagugcuaccaguucgcccuggggcagggcacgacccucgacaacaagcacuccaacgacaccauccacgaccgcaucccgcaccggacccugcugaugaacgagcucggcguccccuuccaccuggggacgcgccaggugugcguggccuggagcuccagcuccugccacgacggcaaggcguggcugcacgucugcgugaccggggacgacaagaacgccaccgccagcuucaucuacgacggccggcucguggacuccaucgggagcuggucccagaacauccugcgcacccaggagagcgagugcgucugcaucaacggcacgugcaccguggugaugaccgacggcuccgccagcgggcgggcggacacccgcauccuguucaucgaggagggcaagaucguccacaucagcccccucuccgggagcgcccagcacguggaggagugcuccugcuacccccgguacccggacgugcgcugcaucugccgggacaacuggaagggcagcaaccgccccgucaucgacaucaacauggaggacuacuccaucgacagcuccuacgugugcagcggccuggugggggacacgccccggaacgacgaccgcuccagcaacuccaacugccggaaccccaacaacgagcgcggcaacccgggggucaagggcugggccuucgacaacggggacgacguguggaugggccggaccaucagcaaggaccugcgcuccggcuacgagaccuucaaggucaucgggggcuggagcacccccaacuccaagagccagaucaaccgccaggugaucguggacuccaacaacuggagcggguacuccggcaucuucagcgucgagggcaagagcugcaucaaccggugcuucuacguggagcucauccgcgggcggcagcaggagacgcgcgugugguggaccuccaacagcaucgucguguucugcggcaccuccgggaccuacggcacggggagcuggcccgacggcgccaacaucaacuucaugcccaucuga

SEQ ID NO: 84202 - RNA, 1410 nt, Artificial Sequence
  derived and/or modified sequence opt1 from neuraminidase__InfluenzaA__AFV53285
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacaucgaggagugcuccugcuacccccggcacccggacguccgcugcaucugccgggacaacuggaagggcagcaaccgccccgugaucaacaucaacauggaggacuacuccaucgacagcuccuacgugugcagcgggcuggucggcgacacgccccggaacgacgacuccagcuccaacagcaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacagcaagucccaggugaaccgccaggucaucguggacaacaacaacuggagcggcuacuccgggaucuucagcguggagggcaagagcugcaucaaccggugcuucuacgucgagcugauccgcggccgcccccaggagacccgggugugguggaccuccaacagcaucguggucuucugcgggaccuccggcacguacgggaccggcagcuggcccgacggggccaacaucaacuucaugccgaucuga

SEQ ID NO: 84203 - RNA, 1410 nt, Artificial Sequence
  derived and/or modified sequence opt1 from neuraminidase__InfluenzaA__AFV53296
augaaccccaaccagaagaucaucaucaucggcagcgugucccugaccaucgccaccgucugcuuccucaugcagaucgccauccuggugacgaccgugacccugcacuucaagcagcacgagugcgacagcccggcguccaaccaggucaugcccugcgagcccaucaucaucgagcgcaacaucaccgagaucguguaccucaacaacacgaccaucgagaaggagaucugccccgagguggucgaguaccggaacuggagcaagccgcagugccagaucaccggguucgcccccuucuccaaggacaacagcauccgccuguccgccggcggggacaucugggugacccgggagcccuacgugagcugcgaccccuccaagugcuaccaguucgcccugggccaggggacgacccucgacaacaagcacagcaacgacaccauccacgaccgcaucccgcaccggacccugcugaugaacgagcucggcguccccuuccaccugggcacgcgccaggugugcguggccugguccagcuccagcugccacgacgggaaggcguggcugcacgucugcgugaccggcgacgacaagaacgccaccgccuccuucaucuacgacgggcggcucguggacagcaucggcuccuggagccagaacauccugcgcacccaggaguccgagugcgucugcaucaacgggacgugcaccguggugaugaccgacggcagcgccagcggccgggcggacacccgcauccuguucaucgaggaggggaagaucguccacaucagcccccucuccggcuccgcccagcacguggaggagugcagcugcuacccccgguacccggacgugcgcugcaucugccgggacaacuggaagggguccaaccgccccgucaucgacaucaacauggaggacuacagcaucgacuccagcuacgugugcuccggccuggugggcgacacgccccggaacgacgaccgcagcuccaacagcaacugccgggaccccaacaacgagcgcgggaacccgggcgucaaggggugggccuucgacaacggcgacgacguguggauggggcggaccaucuccaaggaccugcgcagcggcuacgagaccuucaaggucaucggcgggugguccacccccaacagcaagucccagaucaaccgccaggugaucguggacagcaacaacugguccggcuacagcgggaucuucagcgucgagggcaaguccugcaucaaccggugcuucuacguggagcucauccgcgggcggcagcaggagacgcgcgugugguggaccagcaacuccaucgucguguucugcggcaccagcggcaccuacgggacgggcuccuggcccgacggggccaacaucaacuucaugcccaucuga

SEQ ID NO: 84204 - RNA, 1410 nt, Artificial Sequence
  derived and/or modified sequence opt1 from neuraminidase__InfluenzaA__AFV53307
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccagcuccugccacgacgggaaggccuggcugcacgugugcgucaccggcgacgaccgcaacgccaccgccagcuucaucuacgacgggcggcucguggacuccaucggcagcuggucccagaacauccugcgcacgcaggagagcgagugcgugugcaucaacgggaccugcaccgucgugaugaccgacggcuccgcgagcggccgggccgacacgcgcauccuguucaucaaggaggggaagaucgugcacaucagcccccucuccggcagcgcccagcacgucgaggagugcuccugcuacccccgguacccggacgugcgcugcaucugccgggacaacuggaagggcagcaaccgccccgugaucgacaucaacauggaggacuacuccaucgacagcuccuacgucugcagcgggcuggugggcgacacgccccggaacgacgacuccagcuccaacagcaacugccgcgaccccaacaacgagcgggggaacccgggcgugaaggggugggccuucgacaacggcgacgacgucuggaugggccgcaccaucaacaaggacucccggagcggguacgagaccuucaaggugaucggcgggugguccacccccaacagcaagucccaggucaaccgccaggugaucguggacaacaacaacuggagcggcuacuccgggaucuucagcgucgagggcaagagcugcaucaaccggugcuucuacguggagcugauccgcggccgcccccaggagacccgggugugguggaccuccaacagcaucgucguguucugcgggaccuccggcacguacgggaccggcagcuggcccgacggggccaacaucaacuucaugccgaucuga

SEQ ID NO: 84205 - RNA, 1410 nt, Artificial Sequence
  derived and/or modified sequence opt1 from neuraminidase__InfluenzaA__AFV53317
augaaccccaaccagaagaucaucaccaucggcagcgugucccugaccaucgccacggucugcuuccucaugcagaucgccauccuggcgaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcagcccgcaccggacgcugcugaugaacgagcucggggugcccuuccaccugggcaccaagcaggucugcgcggccugguccagcuccagcugccacgacgggaaggccuggcugcacgugugcgugaccggcgacgaccgcaacgccaccgcguccuucaucuacgacgggcggcucgucgacagcaucggcuccuggagccagaacauccugcgcacgcaggaguccgagugcgugugcaucaacgggaccugcaccguggucaugaccgacggcagcgccagcggccgggccgacacgcgcauccuguucaucaaggaggggaagaucgugcacaucggcccccucuccggcagcgcccagcacaucgaggagugcuccugcuacccccgguacccggacgugcgcugcaucugccgggacaacuggaaggggagcaaccgccccgucaucgacaucaacauggaggacuacuccaucgacagcuccuacgugugcagcggccuggugggggacacgccccggaacgacgacuccagcuccaacagcaacugccgcgaccccaacaacgagcggggcaacccgggggucaagggcugggccuucgacaacggcgacgacguguggauggggcgcaccaucuccaaggaccugcggagcggcuacgagaccuucaaggugaucgggggcugguccacccccaacagcaagucccaggucaaccgccaggugaucgucgacaacaacaacuggagcggguacuccggcaucuucagcguggagggcaagagcugcaucaaccggugcuucuacguggagcucauccgcgggcgcccccaggagacccgggucugguggaccuccaacagcaucgugguguucugcggcaccuccgggacguacggcaccgggagcuggcccgacggcgcgaacaucaacuucaugccgaucuga

SEQ ID NO: 84206 - RNA, 1410 nt, Artificial Sequence
  derived and/or modified sequence opt1 from neuraminidase__InfluenzaA__AFV53328
augaaccccaaccagaagaucaucaccaucggcagcgugucccugaccaucgccacggucugcuuccucaugcacaucgccauccuggcgaccaccgugacccugcacuucaagcagcacgagugcgacagcccggccuccaaccaggccaugcccugcgagcccaucaucaucgagcgcaacaucacggagaucguguaccucaacaacaccaccaucgagaaggagaucugccccgaggucguggaguaccggaacuggagcaagccgcagugccagaucaccggguucgcccccuucuccaaggacaacagcauccgccuguccgccggcggggacaucugggugacgcgggagcccuacgucagcugcgaccccggcaagugcuaccaguucgcgcuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccagcuccugccacgacgggaaggccuggcugcacgugugcaucaccggcgacgaccgcaacgccaccgcgagcuucaucuacgacgggcggcucguggacuccaucggcagcuggucccagaacauccugcgcacgcaggagagcgagugcgucugcaucaacgggaccugcaccguggugaugaccgacggcuccgccagcggccgggccgacacgcgcauccuguucaucaaggaggggaagaucguccacaucagcccccucuccggcagcgcccagcacaucgaggagugcuccugcuacccccgguacccggacgugcgcugcaucugccgggacaacuggaagggcagcaaccgccccgugaucgacaucaacauggaggacuacuccaucgacagcuccuacgucugcagcgggcuggugggcgacacgccccggaacgacgacuccagcuccaacagcaacugccgcgaccccaacaacgagcgggggaacccgggcgugaaggggugggccuucgacaacggcgacgacgucuggaugggccgcaccaucuccaaggaccugcggagcggguacgagaccuucaaggugaucggcgggugguccacccccaacagcaagucccaggugaaccgccaggucaucguggacaacaacaacuggagcggcuacuccgggaucuucagcgucgagggcaagagcugcaucaaccggugcuucuacguggagcucauccgcggccgcccccaggagacccgggugugguggaccuccaacagcaucgucguguucugcgggaccuccggcacguacgggaccggcagcuggcccgacggggcgaacaucaacuucaugccgaucuga

SEQ ID NO: 84207 - RNA, 1410 nt, Artificial Sequence
  derived and/or modified sequence opt1 from neuraminidase__InfluenzaA__AFV53339
augaaccccaaccagaagaucaucaccaucggcagcgccucccugaccaucgccacggugugcuuccucaugcagaucgcgauccuggucaccaccgugacccugcacuucaagcagcacgagugcgacagcccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugcaagaucaccggguucgcccccuucuccaaggacaacagcauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggagcuccagcuccugccacgacggcaaggccuggcugcacgugugcgugaccggggacgacaagaacgccaccgccagcuucaucuacgacggccggcucgucgacuccaucgggagcuggucccagaacauccugcgcacgcaggagagcgagugcgugugcaucaacgggaccugcaccguggucaugaccgacggcuccgcgagcgggcgggccgacacgcgcauccuguucaucgaggagggcaagaucgugcacaugagcccccucuccgggagcgcccagcacguggaggagugcuccugcuacccccgguacccggacguccgcugcaucugccgggacaacuggaagggcagcaaccgccccgugguggacaucaacauggaggacuacuccaucgacagcuccuacgucugcagcggccuggugggggacacgccccggaacgacgaccgcuccagcaacuccaacugccggaaccccaacaacgagaagggcaaccagggggugaagggcugggccuucgacaacggggacgacgucuggaugggccgcaccaucagcaaggaccugcgguccggcuacgagaccuucaaggugaucgggggcuggagcaccccgaacuccaagagccagaucaaccgccaggucaucguggacuccgacaaccggagcggguacuccggcaucuucagcguggagggcaagagcugcaucaaccgcugcuucuacgucgagcucauccgcggccggaagcaggagacccgcgugugguggaccuccaacagcaucguggucuucugcggcaccuccgggacguacggcaccgggagcuggcccgacggcgccaacaucaaccugaugcccaucuga

SEQ ID NO: 84208 - RNA, 1410 nt, Artificial Sequence; identical to SEQ ID NO: 77746
  derived and/or modified sequence opt1 from neuraminidase__InfluenzaA__AFX96367

SEQ ID NO: 84209 - RNA, 1410 nt, Artificial Sequence; identical to SEQ ID NO: 77746
  derived and/or modified sequence opt1 from neuraminidase__InfluenzaA__AFX96386

SEQ ID NO: 84210 - RNA, 1410 nt, Artificial Sequence; identical to SEQ ID NO: 78100
  derived and/or modified sequence opt1 from neuraminidase__InfluenzaA__AFX96401

SEQ ID NO: 84211 - RNA, 1410 nt, Artificial Sequence; identical to SEQ ID NO: 78100
  derived and/or modified sequence opt1 from neuraminidase__InfluenzaA__AFX96411

SEQ ID NO: 84212 - RNA, 1410 nt, Artificial Sequence; identical to SEQ ID NO: 78100
  derived and/or modified sequence opt1 from neuraminidase__InfluenzaA__AFX96421

SEQ ID NO: 84213 - RNA, 1410 nt, Artificial Sequence; identical to SEQ ID NO: 78100
  derived and/or modified sequence opt1 from neuraminidase__InfluenzaA__AFX96431

SEQ ID NO: 84214 - RNA, 1410 nt, Artificial Sequence; identical to SEQ ID NO: 78100
  derived and/or modified sequence opt1 from neuraminidase__InfluenzaA__AFX96441

SEQ ID NO: 84215 - RNA, 1410 nt, Artificial Sequence; identical to SEQ ID NO: 78100
  derived and/or modified sequence opt1 from neuraminidase__InfluenzaA__AFX96451

SEQ ID NO: 84216 - RNA, 1410 nt, Artificial Sequence; identical to SEQ ID NO: 78100
  derived and/or modified sequence opt1 from neuraminidase__InfluenzaA__AFX96461

SEQ ID NO: 84217 - RNA, 1410 nt, Artificial Sequence; identical to SEQ ID NO: 77746
  derived and/or modified sequence opt1 from neuraminidase__InfluenzaA__AFX96471

SEQ ID NO: 84218 - RNA, 1410 nt, Artificial Sequence; identical to SEQ ID NO: 77746
  derived and/or modified sequence opt1 from neuraminidase__InfluenzaA__AFX96481

SEQ ID NO: 84219 - RNA, 1410 nt, Artificial Sequence; identical to SEQ ID NO: 77746
  derived and/or modified sequence opt1 from neuraminidase__InfluenzaA__AFX96491

SEQ ID NO: 84220 - RNA, 1410 nt, Artificial Sequence; identical to SEQ ID NO: 77746
  derived and/or modified sequence opt1 from neuraminidase__InfluenzaA__AFX96501

SEQ ID NO: 84221 - RNA, 1410 nt, Artificial Sequence; identical to SEQ ID NO: 77746
  derived and/or modified sequence opt1 from neuraminidase__InfluenzaA__AFX96511

SEQ ID NO: 84222 - RNA, 1410 nt, Artificial Sequence
  derived and/or modified sequence opt1 from neuraminidase__InfluenzaA__AFX96521
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacagcucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcagcugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucagcuucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucagcaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 84223 - RNA, 1410 nt, Artificial Sequence; identical to SEQ ID NO: 77746
  derived and/or modified sequence opt1 from neuraminidase__InfluenzaA__AFX96531

SEQ ID NO: 84224 - RNA, 1410 nt, Artificial Sequence; identical to SEQ ID NO: 77746
  derived and/or modified sequence opt1 from neuraminidase__InfluenzaA__AFX96541

SEQ ID NO: 84225 - RNA, 1410 nt, Artificial Sequence; identical to SEQ ID NO: 77746
  derived and/or modified sequence opt1 from neuraminidase__InfluenzaA__AFX96551

SEQ ID NO: 84226 - RNA, 1410 nt, Artificial Sequence; identical to SEQ ID NO: 82270
  derived and/or modified sequence opt1 from neuraminidase__InfluenzaA__AFX96561

SEQ ID NO: 84227 - RNA, 1410 nt, Artificial Sequence; identical to SEQ ID NO: 77746
  derived and/or modified sequence opt1 from neuraminidase__InfluenzaA__AFX96571

SEQ ID NO: 84228 - RNA, 1410 nt, Artificial Sequence; identical to SEQ ID NO: 77746
  derived and/or modified sequence opt1 from neuraminidase__InfluenzaA__AFX96581

SEQ ID NO: 84229 - RNA, 1410 nt, Artificial Sequence; identical to SEQ ID NO: 77746
  derived and/or modified sequence opt1 from neuraminidase__InfluenzaA__AFX96591

SEQ ID NO: 84230 - RNA, 1410 nt, Artificial Sequence; identical to SEQ ID NO: 77746
  derived and/or modified sequence opt1 from neuraminidase__InfluenzaA__AFX96601

SEQ ID NO: 84231 - RNA, 1410 nt, Artificial Sequence; identical to SEQ ID NO: 77746
  derived and/or modified sequence opt1 from neuraminidase__InfluenzaA__AFX96611

SEQ ID NO: 84232 - RNA, 1410 nt, Artificial Sequence; identical to SEQ ID NO: 77746
  derived and/or modified sequence opt1 from neuraminidase__InfluenzaA__AFX96621

SEQ ID NO: 84233 - RNA, 1410 nt, Artificial Sequence; identical to SEQ ID NO: 77746
  derived and/or modified sequence opt1 from neuraminidase__InfluenzaA__AFX96631

SEQ ID NO: 84234 - RNA, 1410 nt, Artificial Sequence
  derived and/or modified sequence opt1 from neuraminidase__InfluenzaA__AFX96641
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagcaaguucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 84235 - RNA, 1410 nt, Artificial Sequence; identical to SEQ ID NO: 77746
  derived and/or modified sequence opt1 from neuraminidase__InfluenzaA__AFX96651

SEQ ID NO: 84236 - RNA, 1410 nt, Artificial Sequence; identical to SEQ ID NO: 77746
  derived and/or modified sequence opt1 from neuraminidase__InfluenzaA__AFX96661

SEQ ID NO: 84237 - RNA, 1410 nt, Artificial Sequence; identical to SEQ ID NO: 77746
  derived and/or modified sequence opt1 from neuraminidase__InfluenzaA__AFX96671

SEQ ID NO: 84238 - RNA, 1410 nt, Artificial Sequence; identical to SEQ ID NO: 77746
  derived and/or modified sequence opt1 from neuraminidase__InfluenzaA__AFX96681

SEQ ID NO: 84239 - RNA, 1410 nt, Artificial Sequence; identical to SEQ ID NO: 77746
  derived and/or modified sequence opt1 from neuraminidase__InfluenzaA__AFX96691

SEQ ID NO: 84240 - RNA, 1410 nt, Artificial Sequence
  derived and/or modified sequence opt1 from neuraminidase__InfluenzaA__AFX96701
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccuucaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcaucaucuccuucugcggcgucaacagcgacaccguggggugguccuggcccgacggcgccgagcugccguucacgaucgacaaguga

SEQ ID NO: 84241 - RNA, 1410 nt, Artificial Sequence; identical to SEQ ID NO: 77746
  derived and/or modified sequence opt1 from neuraminidase__InfluenzaA__AFX96711

SEQ ID NO: 84242 - RNA, 1410 nt, Artificial Sequence
  derived and/or modified sequence opt1 from neuraminidase__InfluenzaA__AFX96721
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccguguggaccagcggguccagcaucuccuucugcggcgucaacagcgacaccguggggugguccuggcccgacggcgccgagcugccguucacgaucgacaaguga

SEQ ID NO: 84243 - RNA, 1410 nt, Artificial Sequence; identical to SEQ ID NO: 84242
  derived and/or modified sequence opt1 from neuraminidase__InfluenzaA__AFX96731

SEQ ID NO: 84244 - RNA, 1410 nt, Artificial Sequence; identical to SEQ ID NO: 77746
  derived and/or modified sequence opt1 from neuraminidase__InfluenzaA__AFX96741

SEQ ID NO: 84245 - RNA, 1410 nt, Artificial Sequence; identical to SEQ ID NO: 77746
  derived and/or modified sequence opt1 from neuraminidase__InfluenzaA__AFX96751

SEQ ID NO: 84246 - RNA, 1410 nt, Artificial Sequence; identical to SEQ ID NO: 78764
  derived and/or modified sequence opt1 from neuraminidase__InfluenzaA__AFX96761

SEQ ID NO: 84247 - RNA, 1410 nt, Artificial Sequence; identical to SEQ ID NO: 77746
  derived and/or modified sequence opt1 from neuraminidase__InfluenzaA__AFX96771

SEQ ID NO: 84248 - RNA, 1410 nt, Artificial Sequence
  derived and/or modified sequence opt1 from neuraminidase__InfluenzaA__AFX96791
augaaccccaaccagaagaucaucaccaucggcagcgugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcaucaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84249 - RNA, 1410 nt, Artificial Sequence; identical to SEQ ID NO: 84248
  derived and/or modified sequence opt1 from neuraminidase__InfluenzaA__AFX96801

SEQ ID NO: 84250 - RNA, 1410 nt, Artificial Sequence
  derived and/or modified sequence opt1 from neuraminidase__InfluenzaA__AFX96811
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugcgccuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 84251 - RNA, 1410 nt, Artificial Sequence; identical to SEQ ID NO: 77746
  derived and/or modified sequence opt1 from neuraminidase__InfluenzaA__AFX96821

SEQ ID NO: 84252 - RNA, 1410 nt, Artificial Sequence; identical to SEQ ID NO: 84248
  derived and/or modified sequence opt1 from neuraminidase__InfluenzaA__AFX96831

SEQ ID NO: 84253 - RNA, 1410 nt, Artificial Sequence
  derived and/or modified sequence opt1 from neuraminidase__InfluenzaA__AFX96841
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugcgccuggccgggaacagcucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugagcugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuacuacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 84254 - RNA, 1410 nt, Artificial Sequence; identical to SEQ ID NO: 77746
  derived and/or modified sequence opt1 from neuraminidase__InfluenzaA__AFX96859

SEQ ID NO: 84255 - RNA, 1410 nt, Artificial Sequence; identical to SEQ ID NO: 77746
  derived and/or modified sequence opt1 from neuraminidase__InfluenzaA__AFX96907

SEQ ID NO: 84256 - RNA, 1410 nt, Artificial Sequence; identical to SEQ ID NO: 77746
  derived and/or modified sequence opt1 from neuraminidase__InfluenzaA__AFX96917

SEQ ID NO: 84257 - RNA, 1410 nt, Artificial Sequence; identical to SEQ ID NO: 77746
  derived and/or modified sequence opt1 from neuraminidase__InfluenzaA__AFX96927

SEQ ID NO: 84258 - RNA, 1410 nt, Artificial Sequence
  derived and/or modified sequence opt1 from neuraminidase__InfluenzaA__AFX96937
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccagcacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84259 - RNA, 1410 nt, Artificial Sequence; identical to SEQ ID NO: 77736
  derived and/or modified sequence opt1 from neuraminidase__InfluenzaA__AFY23991

SEQ ID NO: 84260 - RNA, 1410 nt, Artificial Sequence; identical to SEQ ID NO: 77746
  derived and/or modified sequence opt1 from neuraminidase__InfluenzaA__AFY24001

SEQ ID NO: 84261 - RNA, 1410 nt, Artificial Sequence; identical to SEQ ID NO: 77746
  derived and/or modified sequence opt1 from neuraminidase__InfluenzaA__AFY24022

SEQ ID NO: 84262 - RNA, 1410 nt, Artificial Sequence; identical to SEQ ID NO: 77746
  derived and/or modified sequence opt1 from neuraminidase__InfluenzaA__AFY24043

SEQ ID NO: 84263 - RNA, 1410 nt, Artificial Sequence
  derived and/or modified sequence opt1 from neuraminidase__InfluenzaA__AFY24153
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaccgacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 84264 - RNA, 1410 nt, Artificial Sequence
  derived and/or modified sequence opt1 from neuraminidase__InfluenzaA__AFY24208
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacaaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacgagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagcgccugcgguccggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcucauccgcgggcggaagcaggagaccgaggugcuguggaccuccaacagcaucgucguguucugcggcaccuccgggacguacggcaccgggagcuggccggacggcgccgacaucaaccugaugcccaucuga

SEQ ID NO: 84265 - RNA, 1410 nt, Artificial Sequence; identical to SEQ ID NO: 76937
  derived and/or modified sequence opt1 from neuraminidase__InfluenzaA__AFY24219

SEQ ID NO: 84266 - RNA, 1410 nt, Artificial Sequence
  derived and/or modified sequence opt1 from neuraminidase__InfluenzaA__AGB12978
augaaccccaaccagcgcaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcggcagagcgucguguccgugaagcuggccggcaacagcucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcagcugcuucaccaucaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaagggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 84267 - RNA, 1410 nt, Artificial Sequence; identical to SEQ ID NO: 81265
  derived and/or modified sequence opt1 from neuraminidase__InfluenzaA__AGB12989

SEQ ID NO: 84268 - RNA, 1410 nt, Artificial Sequence; identical to SEQ ID NO: 81717
  derived and/or modified sequence opt1 from neuraminidase__InfluenzaA__AGB13009

SEQ ID NO: 84269 - RNA, 1410 nt, Artificial Sequence; identical to SEQ ID NO: 81717
  derived and/or modified sequence opt1 from neuraminidase__InfluenzaA__AGB13019

SEQ ID NO: 84270 - RNA, 1410 nt, Artificial Sequence; identical to SEQ ID NO: 81717
  derived and/or modified sequence opt1 from neuraminidase__InfluenzaA__AGB13029

SEQ ID NO: 84271 - RNA, 1410 nt, Artificial Sequence; identical to SEQ ID NO: 81966
  derived and/or modified sequence opt1 from neuraminidase__InfluenzaA__AGB13039

SEQ ID NO: 84272 - RNA, 1410 nt, Artificial Sequence; identical to SEQ ID NO: 81717
  derived and/or modified sequence opt1 from neuraminidase__InfluenzaA__AGB13051

SEQ ID NO: 84273 - RNA, 1410 nt, Artificial Sequence
  derived and/or modified sequence opt1 from neuraminidase__InfluenzaA__AGB13069
augaaccccaaccagaagaucaucaccaucggcagcaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccuggaucagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84274 - RNA, 1410 nt, Artificial Sequence
  derived and/or modified sequence opt1 from neuraminidase__InfluenzaA__AGB13074
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 84275 - RNA, 1410 nt, Artificial Sequence
  derived and/or modified sequence opt1 from neuraminidase__InfluenzaA__AGB13115
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugcugcgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcgcggcuccaaccggcccugggugagcuucaaccagaaccuggaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaagggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 84276 - RNA, 1410 nt, Artificial Sequence; identical to SEQ ID NO: 81717
  derived and/or modified sequence opt1 from neuraminidase__InfluenzaA__AGB13133

SEQ ID NO: 84277 - RNA, 1410 nt, Artificial Sequence; identical to SEQ ID NO: 81265
  derived and/or modified sequence opt1 from neuraminidase__InfluenzaA__AGB13152

SEQ ID NO: 84278 - RNA, 1410 nt, Artificial Sequence; identical to SEQ ID NO: 81265
  derived and/or modified sequence opt1 from neuraminidase__InfluenzaA__AGB13162

SEQ ID NO: 84279 - RNA, 1410 nt, Artificial Sequence; identical to SEQ ID NO: 82088
  derived and/or modified sequence opt1 from neuraminidase__InfluenzaA__AGB13173

SEQ ID NO: 84280 - RNA, 1410 nt, Artificial Sequence
  derived and/or modified sequence opt1 from neuraminidase__InfluenzaA__AGB13183
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccaggacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggccccuccgacggccaggccagcuacaagaucuuccgcaucgagaaggggaagaucgugaaguccgucgagaugaacgccccgaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccccggccgaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 84281 - RNA, 1410 nt, Artificial Sequence; identical to SEQ ID NO: 81717
  derived and/or modified sequence opt1 from neuraminidase__InfluenzaA__AGB13193

SEQ ID NO: 84282 - RNA, 1410 nt, Artificial Sequence; identical to SEQ ID NO: 81784
  derived and/or modified sequence opt1 from neuraminidase__InfluenzaA__AGB13203

SEQ ID NO: 84283 - RNA, 1410 nt, Artificial Sequence; identical to SEQ ID NO: 81717
  derived and/or modified sequence opt1 from neuraminidase__InfluenzaA__AGB13213

SEQ ID NO: 84284 - RNA, 1410 nt, Artificial Sequence; identical to SEQ ID NO: 81717
  derived and/or modified sequence opt1 from neuraminidase__InfluenzaA__AGB13223

SEQ ID NO: 84285 - RNA, 1410 nt, Artificial Sequence; identical to SEQ ID NO: 81717
  derived and/or modified sequence opt1 from neuraminidase__InfluenzaA__AGB13233

SEQ ID NO: 84286 - RNA, 1410 nt, Artificial Sequence
  derived and/or modified sequence opt1 from neuraminidase__InfluenzaA__AGB13243
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagcgggggaagaucgugaaguccgucgagaugaacgcccccaacuacuacuacgaggagugcagcugcuaccccgacuccagcgagaucacgugcgugugccgcgacaacuggcacggcuccaaccggcccugggugagcuucaaccagaaccucgaguaccagaucggguacaucugcuccggcgucuucggggacaacccgcgccccaacgacaagaccggcagcugcggccccguguccagcaacggggccaacggcgugaagggguucuccuucaaguacggcaacggggucuggaucggccggaccaagagcaucagcucccgcaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 84287 - RNA, 1410 nt, Artificial Sequence; identical to SEQ ID NO: 81784
  derived and/or modified sequence opt1 from neuraminidase__InfluenzaA__AGB13253

SEQ ID NO: 84288 - RNA, 1410 nt, Artificial Sequence
  derived and/or modified sequence opt1 from neuraminidase__InfluenzaA__AGB13263
augaaccccaaccagaagaucaucaccaucggcagcgugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaaggcccccaacuaccacuacgaggagugcagcugcuaccccgacuccagcgagaucacgugcgugugccgggacaacuggcacggcuccaaccgccccugggucagcuucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucaucgggaucaacgagugguccggcuacagcggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccgucgacaaguga

SEQ ID NO: 84289 - RNA, 1410 nt, Artificial Sequence; identical to SEQ ID NO: 81717
  derived and/or modified sequence opt1 from neuraminidase__InfluenzaA__AGB13273

SEQ ID NO: 84290 - RNA, 1410 nt, Artificial Sequence
  derived and/or modified sequence opt1 from neuraminidase__InfluenzaA__AGB13283
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggcgcggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 84291 - RNA, 1410 nt, Artificial Sequence; identical to SEQ ID NO: 81717
  derived and/or modified sequence opt1 from neuraminidase__InfluenzaA__AGB13293

SEQ ID NO: 84292 - RNA, 1410 nt, Artificial Sequence; identical to SEQ ID NO: 81717
  derived and/or modified sequence opt1 from neuraminidase__InfluenzaA__AGB13303

SEQ ID NO: 84293 - RNA, 1410 nt, Artificial Sequence
  derived and/or modified sequence opt1 from neuraminidase__InfluenzaA__AGB13313
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaagggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgcggagcugccguucaccaucgacaaguga

SEQ ID NO: 84294 - RNA, 1410 nt, Artificial Sequence; identical to SEQ ID NO: 81717
  derived and/or modified sequence opt1 from neuraminidase__InfluenzaA__AGB13323

SEQ ID NO: 84295 - RNA, 1410 nt, Artificial Sequence
  derived and/or modified sequence opt1 from neuraminidase__InfluenzaA__AGB13333
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgccgucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggagcgccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 84296 - RNA, 1410 nt, Artificial Sequence; identical to SEQ ID NO: 81717
  derived and/or modified sequence opt1 from neuraminidase__InfluenzaA__AGB13343

SEQ ID NO: 84297 - RNA, 1410 nt, Artificial Sequence; identical to SEQ ID NO: 81966
  derived and/or modified sequence opt1 from neuraminidase__InfluenzaA__AGB13353

SEQ ID NO: 84298 - RNA, 1410 nt, Artificial Sequence
  derived and/or modified sequence opt1 from neuraminidase__InfluenzaA__AGB13363
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcagcguguccggcugggccaucuacagcaaggacaacuccauccgcaucggcagcaagggggacgucuucgugauccgggagccguucaucuccugcagcccccuggagugccgcaccuucuuccugacccagggcgcccuccugaacgacaagcacuccaacgggaccaucaaggaccggagccccuaccgcacgcugauguccugccccaucggcgaggugccgagccccuacaacagccgguucgaguccgucgcguggagcgccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccccggccgaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcaccccgagcugacgggccuggacugcauccgcccgugcuucuggguggagcucauccggggccgccccaaggagaacaccaucuggaccuccgggagcuccaucagcuucugcggcgugaacuccgacaccgucggguggagcuggcccgacggcgcggagcugcccuucacgaucgacaaguga

SEQ ID NO: 84299 - RNA, 1410 nt, Artificial Sequence
  derived and/or modified sequence opt1 from neuraminidase__InfluenzaA__AGB13383
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcagcgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84300 - RNA, 1410 nt, Artificial Sequence; identical to SEQ ID NO: 81265
  derived and/or modified sequence opt1 from neuraminidase__InfluenzaA__AGB13393

SEQ ID NO: 84301 - RNA, 1410 nt, Artificial Sequence; identical to SEQ ID NO: 81965
  derived and/or modified sequence opt1 from neuraminidase__InfluenzaA__AGB13403

SEQ ID NO: 84302 - RNA, 1410 nt, Artificial Sequence; identical to SEQ ID NO: 81265
  derived and/or modified sequence opt1 from neuraminidase__InfluenzaA__AGB13413

SEQ ID NO: 84303 - RNA, 1410 nt, Artificial Sequence; identical to SEQ ID NO: 81265
  derived and/or modified sequence opt1 from neuraminidase__InfluenzaA__AGB13423

SEQ ID NO: 84304 - RNA, 1410 nt, Artificial Sequence; identical to SEQ ID NO: 81965
  derived and/or modified sequence opt1 from neuraminidase__InfluenzaA__AGB13433

SEQ ID NO: 84305 - RNA, 1410 nt, Artificial Sequence; identical to SEQ ID NO: 81965
  derived and/or modified sequence opt1 from neuraminidase__InfluenzaA__AGB13443

SEQ ID NO: 84306 - RNA, 1410 nt, Artificial Sequence
  derived and/or modified sequence opt1 from neuraminidase__InfluenzaA__AGB13453
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcuucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84307 - RNA, 1410 nt, Artificial Sequence; identical to SEQ ID NO: 81265
  derived and/or modified sequence opt1 from neuraminidase__InfluenzaA__AGB13463

SEQ ID NO: 84308 - RNA, 1410 nt, Artificial Sequence; identical to SEQ ID NO: 81717
  derived and/or modified sequence opt1 from neuraminidase__InfluenzaA__AGB13473

SEQ ID NO: 84309 - RNA, 1410 nt, Artificial Sequence
  derived and/or modified sequence opt1 from neuraminidase__InfluenzaA__AGB13483
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccagcccaaggagaacaccaucuggaccuccgggagcuccaucagcuucugcggcgucaacuccgacaccgugggguggagcuggcccgacggcgccgagcugccguucacgaucgacaaguga

SEQ ID NO: 84310 - RNA, 1410 nt, Artificial Sequence; identical to SEQ ID NO: 82002
  derived and/or modified sequence opt1 from neuraminidase__InfluenzaA__AGB13493

SEQ ID NO: 84311 - RNA, 1410 nt, Artificial Sequence; identical to SEQ ID NO: 81794
  derived and/or modified sequence opt1 from neuraminidase__InfluenzaA__AGB13503

SEQ ID NO: 84312 - RNA, 1410 nt, Artificial Sequence; identical to SEQ ID NO: 79208
  derived and/or modified sequence opt1 from neuraminidase__InfluenzaA__AGB13513

SEQ ID NO: 84313 - RNA, 1410 nt, Artificial Sequence; identical to SEQ ID NO: 82000
  derived and/or modified sequence opt1 from neuraminidase__InfluenzaA__AGB13523

SEQ ID NO: 84314 - RNA, 1410 nt, Artificial Sequence; identical to SEQ ID NO: 82000
  derived and/or modified sequence opt1 from neuraminidase__InfluenzaA__AGB13533

SEQ ID NO: 84315 - RNA, 1410 nt, Artificial Sequence; identical to SEQ ID NO: 81717
  derived and/or modified sequence opt1 from neuraminidase__InfluenzaA__AGB13543

SEQ ID NO: 84316 - RNA, 1410 nt, Artificial Sequence; identical to SEQ ID NO: 81717
  derived and/or modified sequence opt1 from neuraminidase__InfluenzaA__AGB13553

SEQ ID NO: 84317 - RNA, 1410 nt, Artificial Sequence
  derived and/or modified sequence opt1 from neuraminidase__InfluenzaA__AGB13563
augaaccccaaccagaagaucaucaccaucggcagcgugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaaccuggccgggaacagcucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagaacaucagcagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84318 - RNA, 1410 nt, Artificial Sequence; identical to SEQ ID NO: 81717
  derived and/or modified sequence opt1 from neuraminidase__InfluenzaA__AGB13573

SEQ ID NO: 84319 - RNA, 1410 nt, Artificial Sequence
  derived and/or modified sequence opt1 from neuraminidase__InfluenzaA__AGB13583
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucggguccgugaagcuggccggcaacagcucccucugcccggugagcggcugggccaucuacuccaaggacaacagcauccgcaucggguccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgagcgccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaagggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 84320 - RNA, 1410 nt, Artificial Sequence; identical to SEQ ID NO: 81717
  derived and/or modified sequence opt1 from neuraminidase__InfluenzaA__AGB13593

SEQ ID NO: 84321 - RNA, 1410 nt, Artificial Sequence; identical to SEQ ID NO: 81717
  derived and/or modified sequence opt1 from neuraminidase__InfluenzaA__AGB13603

SEQ ID NO: 84322 - RNA, 1410 nt, Artificial Sequence; identical to SEQ ID NO: 81717
  derived and/or modified sequence opt1 from neuraminidase__InfluenzaA__AGB13613

SEQ ID NO: 84323 - RNA, 1410 nt, Artificial Sequence; identical to SEQ ID NO: 81717
  derived and/or modified sequence opt1 from neuraminidase__InfluenzaA__AGB13623

SEQ ID NO: 84324 - RNA, 1410 nt, Artificial Sequence
  derived and/or modified sequence opt1 from neuraminidase__InfluenzaA__AGB13633
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcaucaucuccuucugcggcgucaacagcgacaccguggggugguccuggcccgacggcgccgagcugccguucacgaucgacaaguga

SEQ ID NO: 84325 - RNA, 1410 nt, Artificial Sequence
  derived and/or modified sequence opt1 from neuraminidase__InfluenzaA__AGB13643
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacggcauccgcaucgggagcaagggcgacguguucgugauccgggagcccuucaucuccugcagcccccuggagugccgcaccuucuuccugacccagggggcccuccugaacgacaagcacuccaacggcaccaucaaggaccggagccccuaccgcacgcugauguccugcccgaucggggagguccccagccccuacaacucccgguucgagagcguggccuggagcgcguccgccugccacgacggcaucaacuggcucaccaucggcaucagcgggcccgacaacggcgccguggccguccugaaguacaacgggaucaucaccgacaccaucaaguccuggcgcaacaacauccugcggacgcaggagagcgagugcgugugcgugaacggcuccugcuucaccgucaugaccgacggcccgagcgacgggcaggcguccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccgugaagcaggacaucaucggcaucaacgaguggagcggguacuccggcagcuucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 84326 - RNA, 1410 nt, Artificial Sequence
  derived and/or modified sequence opt1 from neuraminidase__InfluenzaA__AGB13653
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcgugaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84327 - RNA, 1410 nt, Artificial Sequence; identical to SEQ ID NO: 81265
  derived and/or modified sequence opt1 from neuraminidase__InfluenzaA__AGB13663

SEQ ID NO: 84328 - RNA, 1410 nt, Artificial Sequence; identical to SEQ ID NO: 81265
  derived and/or modified sequence opt1 from neuraminidase__InfluenzaA__AGB13724

SEQ ID NO: 84329 - RNA, 1410 nt, Artificial Sequence; identical to SEQ ID NO: 81717
  derived and/or modified sequence opt1 from neuraminidase__InfluenzaA__AGB13734

SEQ ID NO: 84330 - RNA, 1410 nt, Artificial Sequence; identical to SEQ ID NO: 78222
  derived and/or modified sequence opt1 from neuraminidase__InfluenzaA__AGB51359

SEQ ID NO: 84331 - RNA, 1410 nt, Artificial Sequence
  derived and/or modified sequence opt1 from neuraminidase__InfluenzaA__AGB97270
augaaccccaaccagaagaucaucaccaucggcagcgugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggagguccccucccccuacaacagccgcuucgagagcguggccugguccgcgagcgccugccacgacggcaucaacuggcucaccaucgggaucuccggccccgacaacggcgccauggccgugcugaaguacaacgggaucaucaccgacaccaucaagagcuggcggaacaacauccugcgcacgcaggaguccgagugcgcgugcgucaacggcagcugcuucaccaucaugaccgacgggccguccgacggccaggccagcuacaagaucuuccggaucgagaagggcaagaucgugaaguccguggagaugaacgcccccaacuaccacuacgaggagugcagcugcuaccccgacuccagcgagaucacgugcgucugccgcgacaacuggcacggguccaaccggcccugggugagcuucaaccagaaccucgaguaccagaucggcuacaucugcuccgggaucuucggcgacaacccgcgccccaacgacaagaccgggagcugcggccccguguccagcaacggcgccaacggggucaagggcuucuccuucaaguacgggaacggcguguggaucgggcggaccaagagcaucagcucccgcaagggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 84332 - RNA, 1410 nt, Artificial Sequence
  derived and/or modified sequence opt1 from neuraminidase__InfluenzaA__AGB97274
augaaccccaaccagaagaucaucaccaucggcagcgugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacagcucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugagcugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgagaagggcaagaucgugaaguccgucgagaugaacgcccccaacuaccacuacgaggagugcagcugcuaccccgacuccagcgagaucacgugcgugugccgcgacaacuggcacggguccaaccggcccugggugagcuucaaccagaaccucgaguaccagaucggcuacaucugcuccgggaucuucggcgacaacccgcgccccaacgacaagaccgggagcugcggccccgucuccagcaacggcgccaacggggugaagggcuucuccuucaaguacgggaacggcguguggaucgggcggaccaagagcaucagcucccgcaagggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 84333 - RNA, 1410 nt, Artificial Sequence; identical to SEQ ID NO: 83154
  derived and/or modified sequence opt1 from neuraminidase__InfluenzaA__AGB97289

SEQ ID NO: 84334 - RNA, 1410 nt, Artificial Sequence
  derived and/or modified sequence opt1 from neuraminidase__InfluenzaA__AGE15475
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucagcaucgacaaguga

SEQ ID NO: 84335 - RNA, 1410 nt, Artificial Sequence
  derived and/or modified sequence opt1 from neuraminidase__InfluenzaA__AGE15476
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84336 - RNA, 1410 nt, Artificial Sequence; identical to SEQ ID NO: 84166
  derived and/or modified sequence opt1 from neuraminidase__InfluenzaA__AGE15477

SEQ ID NO: 84337 - RNA, 1410 nt, Artificial Sequence
  derived and/or modified sequence opt1 from neuraminidase__InfluenzaA__AGE15478
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucagcucccggaagggcuucgagaugaucugggaccccaacggguggaccggcaccgacaacuacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaagagcgacaccguggggugguccuggcccgacggcgccgagcugccguucacgaucgacaaguga

SEQ ID NO: 84338 - RNA, 1410 nt, Artificial Sequence
  derived and/or modified sequence opt1 from neuraminidase__InfluenzaA__AGE15479
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcucccuccugaacgacaagcacagcaacgggaccaucaaggaccggucccccuaccgcacgcugaugagcugcccgaucggcgagguccccagccccuacaacucccgguucgagagcguggccugguccgccagcgcgugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgccugcgugaacgggagcugcuucaccaucaugaccgacggcccgaucgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacuacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84339 - RNA, 1410 nt, Artificial Sequence; identical to SEQ ID NO: 84166
  derived and/or modified sequence opt1 from neuraminidase__InfluenzaA__AGE15480

SEQ ID NO: 84340 - RNA, 1410 nt, Artificial Sequence; identical to SEQ ID NO: 79208
  derived and/or modified sequence opt1 from neuraminidase__InfluenzaA__AGE89270

SEQ ID NO: 84341 - RNA, 1410 nt, Artificial Sequence; identical to SEQ ID NO: 79208
  derived and/or modified sequence opt1 from neuraminidase__InfluenzaA__AGE89280

SEQ ID NO: 84342 - RNA, 1410 nt, Artificial Sequence
  derived and/or modified sequence opt1 from neuraminidase__InfluenzaA__AGE89290
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaucguggucaugaccgacggguccgccagcggcaaggccgacaccaagauccucuucguggaggagggcaagaucgugcacaccagcacgcuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucaucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 84343 - RNA, 1410 nt, Artificial Sequence; identical to SEQ ID NO: 81265
  derived and/or modified sequence opt1 from neuraminidase__InfluenzaA__AGE89301

SEQ ID NO: 84344 - RNA, 1410 nt, Artificial Sequence
  derived and/or modified sequence opt1 from neuraminidase__InfluenzaA__AGE89311
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccgcaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcauguccuucugcggcgucaacagcgacaccguggggugguccuggcccgacggcgccgagcugccguucacgaucgacaaguga

SEQ ID NO: 84345 - RNA, 1410 nt, Artificial Sequence; identical to SEQ ID NO: 82795
  derived and/or modified sequence opt1 from neuraminidase__InfluenzaA__AGE89321

SEQ ID NO: 84346 - RNA, 1410 nt, Artificial Sequence; identical to SEQ ID NO: 82151
  derived and/or modified sequence opt1 from neuraminidase__InfluenzaA__AGE89332

SEQ ID NO: 84347 - RNA, 1410 nt, Artificial Sequence; identical to SEQ ID NO: 81265
  derived and/or modified sequence opt1 from neuraminidase__InfluenzaA__AGE89343

SEQ ID NO: 84348 - RNA, 1410 nt, Artificial Sequence
  derived and/or modified sequence opt1 from neuraminidase__InfluenzaA__AGE89353
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 84349 - RNA, 1410 nt, Artificial Sequence; identical to SEQ ID NO: 82002
  derived and/or modified sequence opt1 from neuraminidase__InfluenzaA__AGE89364

SEQ ID NO: 84350 - RNA, 1410 nt, Artificial Sequence; identical to SEQ ID NO: 82795
  derived and/or modified sequence opt1 from neuraminidase__InfluenzaA__AGE89374

SEQ ID NO: 84351 - RNA, 1410 nt, Artificial Sequence
  derived and/or modified sequence opt1 from neuraminidase__InfluenzaA__AGE89385
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 84352 - RNA, 1410 nt, Artificial Sequence
  derived and/or modified sequence opt1 from neuraminidase__InfluenzaA__AGE89395
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84353 - RNA, 1410 nt, Artificial Sequence; identical to SEQ ID NO: 79208
  derived and/or modified sequence opt1 from neuraminidase__InfluenzaA__AGE89425

SEQ ID NO: 84354 - RNA, 1410 nt, Artificial Sequence; identical to SEQ ID NO: 80526
  derived and/or modified sequence opt1 from neuraminidase__InfluenzaA__AGE89722

SEQ ID NO: 84355 - RNA, 1410 nt, Artificial Sequence
  derived and/or modified sequence opt1 from neuraminidase__InfluenzaA__AGE89733
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccgaacgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaaguccaucagcagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84356 - RNA, 1410 nt, Artificial Sequence
  derived and/or modified sequence opt1 from neuraminidase__InfluenzaA__AGE89743
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggacaaggacaaccgguccggcuacagcgggaucuucuccgucgagggcaagagcugcaucaaccgcugcuucuacguggagcucauccgggggcgcaaggaggagaccgaggugcuguggaccagcaacuccaucgucguguucugcggcacgagcggcaccuacgggaccggcuccuggccggacggggccgaccugaaccucaugcccaucuga

SEQ ID NO: 84357 - RNA, 1410 nt, Artificial Sequence; identical to SEQ ID NO: 82795
  derived and/or modified sequence opt1 from neuraminidase__InfluenzaA__AGE89754

SEQ ID NO: 84358 - RNA, 1410 nt, Artificial Sequence; identical to SEQ ID NO: 82795
  derived and/or modified sequence opt1 from neuraminidase__InfluenzaA__AGE89765

SEQ ID NO: 84359 - RNA, 1410 nt, Artificial Sequence
  derived and/or modified sequence opt1 from neuraminidase__InfluenzaA__AGG13414
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacuccgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgguacccgggcguccgcugcgugugccgggacaacuggaagggguccaaccgccccaucguggacaucaacaucaaggaccacagcaucgucucccgguacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaacaagcaggucaucguggaccggggcgaccgcuccggguacagcggcaucuucuccguggagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84360 - RNA, 1410 nt, Artificial Sequence; identical to SEQ ID NO: 83154
  derived and/or modified sequence opt1 from neuraminidase__InfluenzaA__AGG13426

SEQ ID NO: 84361 - RNA, 1410 nt, Artificial Sequence; identical to SEQ ID NO: 83154
  derived and/or modified sequence opt1 from neuraminidase__InfluenzaA__AGG13438

SEQ ID NO: 84362 - RNA, 1410 nt, Artificial Sequence
  derived and/or modified sequence opt1 from neuraminidase__InfluenzaA__AGG13498
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagaacugcaucaaccggugcuucuacguggagcucauccgcggccggaaggaggagaccgaggugcuguggaccuccaacagcaucgucguguucugcgggaccagcggcacguacgggaccggcuccuggccggacggggccgaccugaaccucaugcccaucuga

SEQ ID NO: 84363 - RNA, 1410 nt, Artificial Sequence; identical to SEQ ID NO: 83154
  derived and/or modified sequence opt1 from neuraminidase__InfluenzaA__AGG13510

SEQ ID NO: 84364 - RNA, 1410 nt, Artificial Sequence; identical to SEQ ID NO: 84362
  derived and/or modified sequence opt1 from neuraminidase__InfluenzaA__AGG13522

SEQ ID NO: 84365 - RNA, 1410 nt, Artificial Sequence
  derived and/or modified sequence opt1 from neuraminidase__InfluenzaA__AGG13534
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 84366 - RNA, 1410 nt, Artificial Sequence
  derived and/or modified sequence opt1 from neuraminidase__InfluenzaA__AGG13546
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggcgcggcagcaaccggcccaucguggacaucaacaucaaggaccacuccaucgucagcuccuacgugugcagcggccuggugggggacaccccgcgcaagaacgacuccagcuccagcucccacugccuggaccccaacaacgaggagggcgggcacggcgucaaggggugggccuucgacgacggcaacgacguguggaugggccggaccaucaacgagacgagccgccucggguacgagaccuucaaggucaucgagggcugguccaaccccaagagcaagcugcagaucaaccgccaggugaucguggaccgguccgaccggagcggguacuccggcaucuucagcgucgagggcaagagcugcaucaaccgcugcuucuacguggagcugauccgggggcgcaaggaggagaccgaggugcucuggaccuccaacagcaucgucguguucugcggcacguccgggaccuacggcaccgggagcuggcccgacggcgccgaccugaaccugaugcccaucuga

SEQ ID NO: 84367 - RNA, 1410 nt, Artificial Sequence; identical to SEQ ID NO: 83154
  derived and/or modified sequence opt1 from neuraminidase__InfluenzaA__AGG13558

SEQ ID NO: 84368 - RNA, 1410 nt, Artificial Sequence; identical to SEQ ID NO: 83154
  derived and/or modified sequence opt1 from neuraminidase__InfluenzaA__AGG13570

SEQ ID NO: 84369 - RNA, 1410 nt, Artificial Sequence
  derived and/or modified sequence opt1 from neuraminidase__InfluenzaA__AGG13582
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggaggacaagaacgcgaccgccagcuucaucuacaacggccggcucguggacuccguggucagcugguccaaggagacccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 84370 - RNA, 1410 nt, Artificial Sequence; identical to SEQ ID NO: 83154
  derived and/or modified sequence opt1 from neuraminidase__InfluenzaA__AGG13606

SEQ ID NO: 84371 - RNA, 1410 nt, Artificial Sequence
  derived and/or modified sequence opt1 from neuraminidase__InfluenzaA__AGG13618
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuaccugugcagcggccuggugggggacacgccccggaagaacgacggcuccagcuccagccacugccucgaccccaacaacgaggagggcgggcacggggugaagggcugggccuucgacgacggcaacgacgucuggauggggcgcaccaucaacgagaccucccggcugggcuacgagaccuucaaggugaucgagggguggagcaacccgaaguccaagcugcagaucaaccgccagaucaucgucgaccggggcgaccgcagcggguacuccggcaucuucagcguggagggcaaguccugcaucaaccggugcuucuacguggagcucauccgcgggcggaaggaggagaccgagguccuguggaccagcaacagcaucgugguguucugcggcacguccgggaccuacggcaccgggagcuggcccgacggcgccgaccugaaccucaugcccaucuga

SEQ ID NO: 84372 - RNA, 1410 nt, Artificial Sequence
  derived and/or modified sequence opt1 from neuraminidase__InfluenzaA__AGG13630
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggaggacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84373 - RNA, 1410 nt, Artificial Sequence; identical to SEQ ID NO: 83154
  derived and/or modified sequence opt1 from neuraminidase__InfluenzaA__AGG13642

SEQ ID NO: 84374 - RNA, 1410 nt, Artificial Sequence
  derived and/or modified sequence opt1 from neuraminidase__InfluenzaA__AGG13654
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcgccguggucaugaccgacggguccgccagcggcaaggcggacaccaagauccucuucaucgaggagggcaagaucgugcagaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagaacugcaucaaccggugcuucuacguggagcucauccgcggccggaaggaggagaucgaggugcuguggaccuccaacagcaucgucguguucugcgggaccagcggcaccuacgggacgggcuccuggccggacggggccgaccugaaccucaugcccaucuga

SEQ ID NO: 84375 - RNA, 1410 nt, Artificial Sequence; identical to SEQ ID NO: 84365
  derived and/or modified sequence opt1 from neuraminidase__InfluenzaA__AGG13666

SEQ ID NO: 84376 - RNA, 1410 nt, Artificial Sequence
  derived and/or modified sequence opt1 from neuraminidase__InfluenzaA__AGG13678
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgccccuguccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucggccccaacaacgaggagggcgggcacggggucaagggcugggccuucgacgacggcaacgacguguggauggggcgcaccaucaacgagacgagccggcugggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacggccgggaccuacggcaccgggagcuggcccgacggcgccgaccugaaccucaugcccaucuga

SEQ ID NO: 84377 - RNA, 1410 nt, Artificial Sequence; identical to SEQ ID NO: 83154
  derived and/or modified sequence opt1 from neuraminidase__InfluenzaA__AGG13690

SEQ ID NO: 84378 - RNA, 1410 nt, Artificial Sequence
  derived and/or modified sequence opt1 from neuraminidase__InfluenzaA__AGG13702
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggaacgcgcagcacguggaggagugcagcugcuacccccgguacccgggcguccgcugcgugugccgggacaacuggaagggguccaaccgccccaucguggacaucaacaucaaggaccacagcaucgucucccgguacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccuccaacagcaucgucguguucugcggcacgagcgggaccuacggcaccggguccuggcccgacggcgccgaccugaaccugaugcccaucuga

SEQ ID NO: 84379 - RNA, 1410 nt, Artificial Sequence; identical to SEQ ID NO: 84362
  derived and/or modified sequence opt1 from neuraminidase__InfluenzaA__AGG13714

SEQ ID NO: 84380 - RNA, 1410 nt, Artificial Sequence; identical to SEQ ID NO: 83154
  derived and/or modified sequence opt1 from neuraminidase__InfluenzaA__AGG13726

SEQ ID NO: 84381 - RNA, 1410 nt, Artificial Sequence; identical to SEQ ID NO: 83154
  derived and/or modified sequence opt1 from neuraminidase__InfluenzaA__AGG13738

SEQ ID NO: 84382 - RNA, 1410 nt, Artificial Sequence; identical to SEQ ID NO: 83154
  derived and/or modified sequence opt1 from neuraminidase__InfluenzaA__AGG13750

SEQ ID NO: 84383 - RNA, 1410 nt, Artificial Sequence
  derived and/or modified sequence opt1 from neuraminidase__InfluenzaA__AGG13762
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccgccaggugaucguggaccggggcgaccggagcggguacuccggcaucuucagcgucgaggggaaguccugcaucaaccgcugcuucuacguggagcugauccggggccgcaaggaggagaccgaggugcucuggaccagcaacagcaucgucguguucugcggcacguccgggaccuacggcaccgggagcuggcccgacggcgccgaccugaaccugaugcccaucuga

SEQ ID NO: 84384 - RNA, 1410 nt, Artificial Sequence
  derived and/or modified sequence opt1 from neuraminidase__InfluenzaA__AGG13774
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacgcaggagagcgagugcgugugcaucaacgggaccugcgccguggucaugaccgacggcuccgccagcggcaaggcggacaccaagauccucuucaucgaggagggcaagaucgugcacacgagcacccuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcgggcacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagaacugcaucaaccggugcuucuacguggagcucauccgcggccggaaggaggagaccgaggugcuguggaccuccaacagcaucgucguguucugcgggacgagcggcaccuacgggaccggcuccuggccggacggggccgaccugaaccucaugcccaucuga

SEQ ID NO: 84385 - RNA, 1410 nt, Artificial Sequence
  derived and/or modified sequence opt1 from neuraminidase__InfluenzaA__AGG13786
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaaccugcacuccaacaacaccgugcgcgaccggacccccuaccgcacccugcucaugaacgagcugggcguccccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccucgaccccaacaacgaggagggcgggcacggcgugaaggggugggccuucgacgacggcaacgacgucuggaugggccgcaccaucaacgagacgagccggcugggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggcccgacggggccgaccugaaccucaugcccaucuga

SEQ ID NO: 84386 - RNA, 1410 nt, Artificial Sequence; identical to SEQ ID NO: 84362
  derived and/or modified sequence opt1 from neuraminidase__InfluenzaA__AGG13798

SEQ ID NO: 84387 - RNA, 1410 nt, Artificial Sequence
  derived and/or modified sequence opt1 from neuraminidase__InfluenzaA__AGG13810
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccuggggcccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaaguccugcaucaaccgcugcuucuacguggagcugauccggggccgcaaggaggagaccgaggugcucuggaccagcaacagcaucgucguguucugcgggacguccggcaccuacgggaccggcagcuggcccgacggggccgaccugaaccugaugcccaucuga

SEQ ID NO: 84388 - RNA, 1410 nt, Artificial Sequence; identical to SEQ ID NO: 84362
  derived and/or modified sequence opt1 from neuraminidase__InfluenzaA__AGG13822

SEQ ID NO: 84389 - RNA, 1410 nt, Artificial Sequence; identical to SEQ ID NO: 84362
  derived and/or modified sequence opt1 from neuraminidase__InfluenzaA__AGG13834

SEQ ID NO: 84390 - RNA, 1410 nt, Artificial Sequence; identical to SEQ ID NO: 84383
  derived and/or modified sequence opt1 from neuraminidase__InfluenzaA__AGG13846

SEQ ID NO: 84391 - RNA, 1410 nt, Artificial Sequence; identical to SEQ ID NO: 83154
  derived and/or modified sequence opt1 from neuraminidase__InfluenzaA__AGG13858

SEQ ID NO: 84392 - RNA, 1410 nt, Artificial Sequence
  derived and/or modified sequence opt1 from neuraminidase__InfluenzaA__AGG13870
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggaccgcugcuaccaguucgcccuggggcagggcaccacgcucaacaacaugcacuccaacaacaccgugcgggaccgcacccccuaccggacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggugagcugguccaaggagauccugcggacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgcuacccgggggugcggugcgucugccgcgacaacuggaagggcagcaaccggcccaucguggacaucaacaucaaggaccacuccaucgugagcuccuacgucugcagcggccuggugggggacaccccgcgcaagaacgacuccagcuccagcucccacugccuggaccccaacaacgaggagggcgggcacggcgugaaggggugggccuucgacgacggcaacgacgucuggaugggccggaccaucaacgagacgagccgccucggguacgagaccuucaaggugaucgagggcugguccaaccccaagagcaagcugcagaucaaccggcaggucaucguggaccgcggggaccgguccggcuacagcgggaucuucuccguggagggcaccagcugcaucaaccgcugcuucuacgucgagcugauccggggccgcaaggaggagaccgaggugcucuggacgagcaacuccaucguggucuucugcgggaccagcggcaccuacgggaccggcuccuggcccgacggggccgaccugaaccugaugcccaucuga

SEQ ID NO: 84393 - RNA, 1410 nt, Artificial Sequence
  derived and/or modified sequence opt1 from neuraminidase__InfluenzaA__AGG13894
augaaccccaaccagaagaucaucaccaucggcagcgugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacgucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84394 - RNA, 1410 nt, Artificial Sequence; identical to SEQ ID NO: 84362
  derived and/or modified sequence opt1 from neuraminidase__InfluenzaA__AGG13906

SEQ ID NO: 84395 - RNA, 1410 nt, Artificial Sequence
  derived and/or modified sequence opt1 from neuraminidase__InfluenzaA__AGG13930
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgaccgcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaaguccugcaucaaccgcugcuucuacguggagcugauccggggccgcaaggaggagaccgaggugcucuggaccagcaacagcaucgucguguucugcgggacguccggcaccuacgggaccggcagcuggcccgacggggccgaccugaaccugaugcccaucuga

SEQ ID NO: 84396 - RNA, 1410 nt, Artificial Sequence; identical to SEQ ID NO: 84372
  derived and/or modified sequence opt1 from neuraminidase__InfluenzaA__AGG13942

SEQ ID NO: 84397 - RNA, 1410 nt, Artificial Sequence
  derived and/or modified sequence opt1 from neuraminidase__InfluenzaA__AGG13965
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84398 - RNA, 1410 nt, Artificial Sequence; identical to SEQ ID NO: 84365
  derived and/or modified sequence opt1 from neuraminidase__InfluenzaA__AGG13976

SEQ ID NO: 84399 - RNA, 1410 nt, Artificial Sequence; identical to SEQ ID NO: 84365
  derived and/or modified sequence opt1 from neuraminidase__InfluenzaA__AGG13988

SEQ ID NO: 84400 - RNA, 1410 nt, Artificial Sequence; identical to SEQ ID NO: 84365
  derived and/or modified sequence opt1 from neuraminidase__InfluenzaA__AGG14000

SEQ ID NO: 84401 - RNA, 1410 nt, Artificial Sequence; identical to SEQ ID NO: 84365
  derived and/or modified sequence opt1 from neuraminidase__InfluenzaA__AGG14012

SEQ ID NO: 84402 - RNA, 1410 nt, Artificial Sequence; identical to SEQ ID NO: 84383
  derived and/or modified sequence opt1 from neuraminidase__InfluenzaA__AGG14024

SEQ ID NO: 84403 - RNA, 1410 nt, Artificial Sequence
  derived and/or modified sequence opt1 from neuraminidase__InfluenzaA__AGG14036
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacaugugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucaacgagaccucccggcugggguacgagaccuucaaggugaucgagggcuggagcaaccccaaguccaagcugcagaucaaccgccaggucaucguggaccgggggaaccgcagcggcuacuccgggaucuucagcguggagggcaagaacugcaucaaccggugcuucuacgucgagcucauccgcggccggaaggaggagaccgaggugcuguggaccuccaacagcaucguggucuucugcgggaccagcggcacguacgggaccggcuccuggccggacggggccgaccugaaccucaugcccaucuga

SEQ ID NO: 84404 - RNA, 1410 nt, Artificial Sequence; identical to SEQ ID NO: 84383
  derived and/or modified sequence opt1 from neuraminidase__InfluenzaA__AGG14321

SEQ ID NO: 84405 - RNA, 1410 nt, Artificial Sequence; identical to SEQ ID NO: 83154
  derived and/or modified sequence opt1 from neuraminidase__InfluenzaA__AGG14333

SEQ ID NO: 84406 - RNA, 1410 nt, Artificial Sequence; identical to SEQ ID NO: 82795
  derived and/or modified sequence opt1 from neuraminidase__InfluenzaA__AGG84182

SEQ ID NO: 84407 - RNA, 1398 nt, Artificial Sequence
  derived and/or modified sequence opt1 from neuraminidase__InfluenzaA__AGJ51955
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugcucuggaccggggacuccaucgucagcaugugcuccagcaccgaguuccugggccaguggaacuggcccgacggggccaagaucgaguacuuccuguga

SEQ ID NO: 84408 - RNA, 1398 nt, Artificial Sequence
  derived and/or modified sequence opt1 from neuraminidase__InfluenzaA__AGJ72863
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggaggugauccgcggccggcccaaggaggacaaggucuggugggccgggaacuccaucgugagcaugugcuccagcaccgaguuccugggccaguggaacuggcccgacggggccaagaucgaguacuuccucuga

SEQ ID NO: 84409 - RNA, 1410 nt, Artificial Sequence
  derived and/or modified sequence opt1 from neuraminidase__InfluenzaA__AGJ73328
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaacggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 84410 - RNA, 1410 nt, Artificial Sequence; identical to SEQ ID NO: 81265
  derived and/or modified sequence opt1 from neuraminidase__InfluenzaA__AGJ73330

SEQ ID NO: 84411 - RNA, 1410 nt, Artificial Sequence
  derived and/or modified sequence opt1 from neuraminidase__InfluenzaA__AGJ73332
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccacaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84412 - RNA, 1410 nt, Artificial Sequence; identical to SEQ ID NO: 81265
  derived and/or modified sequence opt1 from neuraminidase__InfluenzaA__AGJ73334

SEQ ID NO: 84413 - RNA, 1410 nt, Artificial Sequence; identical to SEQ ID NO: 81265
  derived and/or modified sequence opt1 from neuraminidase__InfluenzaA__AGJ73336

SEQ ID NO: 84414 - RNA, 1410 nt, Artificial Sequence; identical to SEQ ID NO: 81265
  derived and/or modified sequence opt1 from neuraminidase__InfluenzaA__AGJ73338

SEQ ID NO: 84415 - RNA, 1410 nt, Artificial Sequence
  derived and/or modified sequence opt1 from neuraminidase__InfluenzaA__AGJ73340
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggccuccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgcguggagcgccuccgccugccacgacgggaucaacuggcucaccaucggcaucagcggccccgacaacggggccguggcggugcugaaguacaacggcaucaucaccgacaccaucaaguccuggcgcaacaacauccugcggacgcaggagagcgagugcgccugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 84416 - RNA, 1410 nt, Artificial Sequence
  derived and/or modified sequence opt1 from neuraminidase__InfluenzaA__AGJ73342
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgggaccgugggcuggagcuggcccgacggcgccgagcugccguucacgaucgacaaguga

SEQ ID NO: 84417 - RNA, 1410 nt, Artificial Sequence; identical to SEQ ID NO: 81717
  derived and/or modified sequence opt1 from neuraminidase__InfluenzaA__AGJ73344

SEQ ID NO: 84418 - RNA, 1410 nt, Artificial Sequence
  derived and/or modified sequence opt1 from neuraminidase__InfluenzaA__AGJ73346
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagaagugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacgaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagagcacgaucuggaccuccgggagcuccaucagcuucugcggcgucaacuccgacaccgugggguggagcuggcccgacggcgccgagcugccguucaccaucgacaaguga

SEQ ID NO: 84419 - RNA, 1410 nt, Artificial Sequence
  derived and/or modified sequence opt1 from neuraminidase__InfluenzaA__AGJ73348
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84420 - RNA, 1410 nt, Artificial Sequence
  derived and/or modified sequence opt1 from neuraminidase__InfluenzaA__AGJ73350
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacgagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgugaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84421 - RNA, 1410 nt, Artificial Sequence
  derived and/or modified sequence opt1 from neuraminidase__InfluenzaA__AGJ73352
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggucgggaacuccagccucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacuccccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84422 - RNA, 1410 nt, Artificial Sequence; identical to SEQ ID NO: 81717
  derived and/or modified sequence opt1 from neuraminidase__InfluenzaA__AGJ73354

SEQ ID NO: 84423 - RNA, 1410 nt, Artificial Sequence
  derived and/or modified sequence opt1 from neuraminidase__InfluenzaA__AGJ73356
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacuucaacaucagcaacacgaacuucgccgcgggccaguccguggucagcgugaagcuggccgggaacuccagccucugcccgguguccggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacaacggggccguggccgugcugaaguacaacggcaucaucaccgacaccaucaaguccuggcgcaacaacauccugcggacgcaggagagcgagugcgcgugcgucaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84424 - RNA, 1410 nt, Artificial Sequence; identical to SEQ ID NO: 81717
  derived and/or modified sequence opt1 from neuraminidase__InfluenzaA__AGJ73358

SEQ ID NO: 84425 - RNA, 1410 nt, Artificial Sequence; identical to SEQ ID NO: 81717
  derived and/or modified sequence opt1 from neuraminidase__InfluenzaA__AGJ73360

SEQ ID NO: 84426 - RNA, 1410 nt, Artificial Sequence
  derived and/or modified sequence opt1 from neuraminidase__InfluenzaA__AGJ73362
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgacggccaguccgucgugagcgugaagcuggcggggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgccugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84427 - RNA, 1410 nt, Artificial Sequence; identical to SEQ ID NO: 82840
  derived and/or modified sequence opt1 from neuraminidase__InfluenzaA__AGJ73364

SEQ ID NO: 84428 - RNA, 1410 nt, Artificial Sequence; identical to SEQ ID NO: 81717
  derived and/or modified sequence opt1 from neuraminidase__InfluenzaA__AGJ73366

SEQ ID NO: 84429 - RNA, 1410 nt, Artificial Sequence; identical to SEQ ID NO: 81265
  derived and/or modified sequence opt1 from neuraminidase__InfluenzaA__AGJ73370

SEQ ID NO: 84430 - RNA, 1410 nt, Artificial Sequence
  derived and/or modified sequence opt1 from neuraminidase__InfluenzaA__AGJ73372
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccacaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84431 - RNA, 1410 nt, Artificial Sequence; identical to SEQ ID NO: 81265
  derived and/or modified sequence opt1 from neuraminidase__InfluenzaA__AGJ73374

SEQ ID NO: 84432 - RNA, 1410 nt, Artificial Sequence
  derived and/or modified sequence opt1 from neuraminidase__InfluenzaA__AGJ73376
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagauccuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcacgaagcaggacaucguggggaucaacgagugguccggcuacagcggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 84433 - RNA, 1410 nt, Artificial Sequence
  derived and/or modified sequence opt1 from neuraminidase__InfluenzaA__AGJ73379
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84434 - RNA, 1410 nt, Artificial Sequence
  derived and/or modified sequence opt1 from neuraminidase__InfluenzaA__AGJ73381
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacgagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84435 - RNA, 1410 nt, Artificial Sequence
  derived and/or modified sequence opt1 from neuraminidase__InfluenzaA__AGK62992
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgaggucaagagcugcaucaaccggugcuucuacguggagcugauccgcgggcggaaggaggagaccgaggugcucuggaccagcaacuccaucgugguguucugcggcacgagcggcaccuacgggaccggcuccuggcccgacggggccgacaucaaccugaugcccaucuga

SEQ ID NO: 84436 - RNA, 1410 nt, Artificial Sequence
  derived and/or modified sequence opt1 from neuraminidase__InfluenzaA__AGK62996
augaaccccaaccagaagaucaucaccaucggcagcgugucccugaucaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccgcgaccggacccccuaccgcacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcggcucguggacuccguggucagcugguccaaggagauccugcgcacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcaccaucaacgagaccagccggcucggcuacgagacguucaaggucaucgaggggugguccaaccccaagagcaagcugcagaucaaccgccaggugaucguggaccggggcgaccgcuccggguacagcggcaucuucuccgucgagagcaagagcugcaucaaccggugcuucuacguggagcugauccgcgggcggaaggaggagaccgaggugcucuggaccuccaacagcaucgucguguucugcggcaccuccggcacguacgggaccggcagcuggcccgacggggccgacaucaaccugaugcccaucuga

SEQ ID NO: 84437 - RNA, 1410 nt, Artificial Sequence
  derived and/or modified sequence opt1 from neuraminidase__InfluenzaA__AGK62998
augaaccccaaccagaagaucaucaccaucggcagcgugucccugaccaucgccacgaucugcuucuucaugcagaucgccauccucaucaccaccgucacccugcacuucaagcagugcgaguucaacagcccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccagcuccagcugccacgacgggaaggcguggcuccacgugugcaucaccggcgacgacaagaacgccaccgccuccuucaucuacaacgggcggcugguggacagcguggucuccuggagcaaggagauccugcgcacccaggaguccgagugcgugugcaucaacggcacgugcaccguggucaugaccgacgggagcgccuccggcaaggcggacaccaagauccucuucaucgaggagggcaagaucgugcacacgagcacccugagcggguccgcccagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccugcucggcgacacgccccggaagaacgacagcuccagcuccagccacugccuggaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaagagcaagcuccagaucaaccgccaggucaucguggaccggggcgaccgcuccggguacagcggcaucuucuccguggagagcaagagcugcaucaaccggugcuucuacgucgagcugauccgcgggcggaaggaggagaccgaggugcuguggaccuccaacagcaucguggucuucugcggcaccuccggcacguacgggaccggcagcuggccggacggggccgacaucaaccucaugcccaucuga

SEQ ID NO: 84438 - RNA, 1410 nt, Artificial Sequence
  derived and/or modified sequence opt1 from neuraminidase__InfluenzaA__AGK63000
augaaccccaaccagaagaucaucaccaucggcagcgugucccugaccaucgccacgaucugcuucuucaugcagaucgccauccucaucaccaccgucacccugcacuucaagcagugcgacuucaacagcccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccagcuccagcugccacgacgggaaggcguggcuccacgugugcaucaccggcgacgacaagaacgccaccgccuccuucaucuacaacgggaagcugguggacagcguggucuccuggagcaaggagauccugcggacccaggaguccgagugcgugugcaucaacggcacgugcaccguggucaugaccgacgggagcgccuccggcaaggcggacaccaagauccucuucaucgaggagggcaagaucgugcacacgagcacccugagcggguccgcccagcacguggaggagugcagcugcuacccccgcuaccccggcguccggugcgugugccgcgacaacuggaagggguccaaccggccgaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaaccccaaguccaagcugcagaucaaccgccaggugaucguggaccggggcgaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggccggacggcgccgacaucaaccugaugcccaucuga

SEQ ID NO: 84439 - RNA, 1410 nt, Artificial Sequence
  derived and/or modified sequence opt1 from neuraminidase__InfluenzaA__AGK63002
augaaccccaaccagaagaucaucaccaucggcagcgugucccugaccaucagcacgaucugcuucuucaugcagaucgccauccucaugaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcaacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaccgagaccagccggcugggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgacaucaaccugaugcccaucuga

SEQ ID NO: 84440 - RNA, 1410 nt, Artificial Sequence
  derived and/or modified sequence opt1 from neuraminidase__InfluenzaA__AGK63004
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcucccagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggcguucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgccgacaucaaccugaugcccaucuga

SEQ ID NO: 84441 - RNA, 1410 nt, Artificial Sequence
  derived and/or modified sequence opt1 from neuraminidase__InfluenzaA__AGK63006
augaaccccaaccagaagaucaucaccaucggcagcgugucccugaccaucgccacgaucugcuucuucaugcagaucgccauccucaucaccaccgucacccugcacuucaagcaguacgaguucaacagcccgcccaacaaccaggugaugcugugcgagcccacgaucaucgagcgcaacaucaccgagaucguguaccucaccaacaccacgaucgagaaggagaucugccccaagccggcggaguaccggaacugguccaagccccagugcgacaucaccggguucgcccccuucagcaaggacaacuccauccgccugagcgccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggcguggcugcacgugugcaucaccggcgacgacaagaacgccaccgccuccuucaucuacaacgggcggcucguggacagcguggucuccuggagcaaggagauccugcgcacccaggaguccgagugcgugugcaucaacggcacgugcaccguggucaugaccgacgggagcgccuccgcgaaggccgacaccaagauccuguucaucgaggagggcaagaucgugcacacgagcacccucagcggcuccgcccagcacguggaggagugcagcugcuacccccgguacuccgggguccgcugcgugugccgggacaacuggaagggcagcaaccgcccgaucguggacaucaacaucaaggaccacuccaucgucagcuccuacgugugcagcgggcuggugggcgacacgccccggaagaacgacuccagcuccagcucccacugccuggaccccaacaacgaggagggcgggcacggcgucaaggggugggccuucgacgacggcaacgacguguggauggggcgcaccaucaacgagaccagccggcucggcuacgagaccuucaaggucaucgagggcugguccaaccccaagagccagcugcagaucaaccgccaggugaucguggaccgcggggaccgguccggcuacagcgggaucuucuccgucgagagcaagagcugcaucaaccggugcuucuacguggagcugauccgcggccggaaggaggagaccgaggugcucuggaccuccaacagcaucgucguguucugcgggacguccggcaccuacggcaccgggagcuggccggacggcgccgacaucaaccugaugcccaucuga

SEQ ID NO: 84442 - RNA, 1410 nt, Artificial Sequence
  derived and/or modified sequence opt1 from neuraminidase__InfluenzaA__AGK63008
augaaccccaaccagaagaucaucaccaucggcagcgugucccugaccaucgccacgaucugcuucuucaugcagaucgccauccucaucaccaccgucacccugcacuucaagcagugcgaguucaacagcccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccagcuccagcugccacgacgggaaggcguggcuccacgugugcaucaccggcgacgacaagaacgccaccgccuccuucaucuacaacgggaagcugguggacagcguggucuccuggagcaaggagauccugcggacccaggaguccgagugcgugugcaucaacggcacgugcaccguggucaugaccgacgggagcgccuccggcaaggcggacaccaagauccucuucaucgaggagggcaagaucgugcacacgagcacccugagcggguccgcccagcacguggaggagugcagcugcuacccccgcuaccccggcguccggugcgugugccgcgacaacuggaagggguccaaccggccgaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaaccccaaguccaagcugcagaugaaccgccaggugaucguggaccggggcgaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggccggacggcgccgacaucaaccugaugcccaucuga

SEQ ID NO: 84443 - RNA, 1410 nt, Artificial Sequence
  derived and/or modified sequence opt1 from neuraminidase__InfluenzaA__AGK63010
augaaccccaaccagaagaucaucaccaucggcagcgugucccugaccaucgccacgaucugcuucuucaugcagaucgccauccucaucaccaccgucacccugcacuucaagcagugcgaguucaacagcccgcccaacaaccaggugaugcugugcgagcccacgaucaucgagcgcaacaucaccgagaucguguaccucaccaacaccacgaucgagaaggagaucugccccaagcuggcggaguaccggaacugguccaagccgcagugcgacaucaccggguucgcccccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcauggccugguccagcuccagcugccacgacgggaaggcguggcuccacgugugcaucaccggcgacgacaagaacgccaccgccuccuucaucuacaacgggaagcugguggacagcguggucuccuggagcaaggagauccugcggacccaggaguccgagugcgugugcaucaacggcacgugcaccguggucaugaccgacgggagcgccuccggcaaggcggacaccaagauccucuucaucgaggagggcaagaucgugcacacgagcacccugagcggguccgcccagcacguggaggagugcagcugcuacccccgcuaccccggcguccggugcgugugccgcgacaacuggaagggguccaaccggccgaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcgaccccaaguccaagcugcagaucaaccgccaggugaucguggaccggggcgaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggccggacggcgccgacaucaaccugaugcccaucuga

SEQ ID NO: 84444 - RNA, 1410 nt, Artificial Sequence
  derived and/or modified sequence opt1 from neuraminidase__InfluenzaA__AGK63012
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcuaccgcuccggguacagcggcaucuucuccgucgagggcaagagcugcaucaaccggugcuucuacguggaccugauccgcgggcggaaggaggagaccgaggugcucuggaccagcaacuccaucgucguguucugcggcacgagcgggaccuacggcaccggguccuggcccgacggcgccgacaucaaccugaugcccaucuga

SEQ ID NO: 84445 - RNA, 1410 nt, Artificial Sequence
  derived and/or modified sequence opt1 from neuraminidase__InfluenzaA__AGK63014
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuucccccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccaccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccgcgguaccccggcguccgcugcgugugccgggacaacuggaaggggagcaaccgccccaucguggacaucaacaucaaggaccacuccaucgucagcuccuacgugugcagcggccucgugggcgacacgccccggaagaacgacuccagcuccagcucccacugccuggacccgaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcuccagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcuguggaccuccaacagcaucgucguguucugcggcaccuccgggacguacggcaccgggagcuggcccgacggcgccgacaucaaccucaugcccaucuga

SEQ ID NO: 84446 - RNA, 1410 nt, Artificial Sequence
  derived and/or modified sequence opt1 from neuraminidase__InfluenzaA__AGK63018
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 84447 - RNA, 1410 nt, Artificial Sequence
  derived and/or modified sequence opt1 from neuraminidase__InfluenzaA__AGK63020
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgacaucaaccugaugcccaucuga

SEQ ID NO: 84448 - RNA, 1410 nt, Artificial Sequence
  derived and/or modified sequence opt1 from neuraminidase__InfluenzaA__AGK63022
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggaccucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 84449 - RNA, 1410 nt, Artificial Sequence; identical to SEQ ID NO: 84447
  derived and/or modified sequence opt1 from neuraminidase__InfluenzaA__AGK63024

SEQ ID NO: 84450 - RNA, 1410 nt, Artificial Sequence; identical to SEQ ID NO: 84447
  derived and/or modified sequence opt1 from neuraminidase__InfluenzaA__AGK63026

SEQ ID NO: 84451 - RNA, 1410 nt, Artificial Sequence
  derived and/or modified sequence opt1 from neuraminidase__InfluenzaA__AGK63028
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaagaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagguggugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggaggccaagagcugcaucauccggugcuucuacguggagcugauccgcgggcggaaggaggagaccgagguccucuggaccagcaacuccaucgugguguucugcggcacgagcggcaccuacgggaccggcuccuggcccgacggggccgacaucaaccugaugcccaucuga

SEQ ID NO: 84452 - RNA, 1410 nt, Artificial Sequence; identical to SEQ ID NO: 84446
  derived and/or modified sequence opt1 from neuraminidase__InfluenzaA__AGK63030

SEQ ID NO: 84453 - RNA, 1410 nt, Artificial Sequence
  derived and/or modified sequence opt1 from neuraminidase__InfluenzaA__AGK63032
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaccgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgacaucaaccugaugcccaucuga

SEQ ID NO: 84454 - RNA, 1410 nt, Artificial Sequence
  derived and/or modified sequence opt1 from neuraminidase__InfluenzaA__AGK63034
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaagguccacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccgccaggugaucgucgaccggggcgaccgguccggguacagcggcaucuucuccguggagggcaagagcugcaucaaccgcugcuucuacguggagcucauccgggggcgcaagaaggagaccgagguccuguggaccagcaacuccaucgugguguucugcggcacgagcgggaccuacggcaccggguccuggccggacggcgccgacaucaaccugaugcccaucuga

SEQ ID NO: 84455 - RNA, 1410 nt, Artificial Sequence
  derived and/or modified sequence opt1 from neuraminidase__InfluenzaA__AGK63036
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccgguucggcuacgagaccaucaaggucaucgaggggugguccaaccccaagagcaaccuccagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcacgagcgggaccuacggcaccggguccuggcccgacggcgccgacaucaaccucaugcccaucuga

SEQ ID NO: 84456 - RNA, 1410 nt, Artificial Sequence
  derived and/or modified sequence opt1 from neuraminidase__InfluenzaA__AGK63038
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggggaccacggcgucaaggggugggccuucgacgacggcaacgacguguggauggggcggaccaucaacgagaccagccgccugggcuacgagaccuucaaggucaucgagggcugguccaaccccaagagcaagcugcagaucaaccgccaggugaucguggaccgggggaaccgguccggcuacagcgggaucuucuccgucgagagcaagagcugcaucaaccgcugcuucuacguggagcucauccggggccgcaaggaggagaccgaggugcuguggaccuccaacagcaucgucguguucugcgggacguccggcaccuacggcaccgggagcuggccggacggcgccgacaucaaccugaugcccaucuga

SEQ ID NO: 84457 - RNA, 1410 nt, Artificial Sequence
  derived and/or modified sequence opt1 from neuraminidase__InfluenzaA__AGK63040
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 84458 - RNA, 1410 nt, Artificial Sequence
  derived and/or modified sequence opt1 from neuraminidase__InfluenzaA__AGK63042
augaaccccaaccagaagaucaucaccaucggcagcgugucccugaccaucagcacgaucugcuucuucaugcagaucgccauccucaucaccaccgucacccugcacuucaagcagugcgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcauggccugguccagcuccagcugccacgacgggaaggccuggcuccacgugugcaucaccggcgacgacaagaacgcgaccgccuccuucaucuacaacgggaagcugguggacagcguggucuccuggagcaaggagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaacccgaaguccaagcugcagaucaaccgccaggugaucguggaccggggcgaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggcccgacggcgccgacaucaaccugaugcccaucuga

SEQ ID NO: 84459 - RNA, 1410 nt, Artificial Sequence
  derived and/or modified sequence opt1 from neuraminidase__InfluenzaA__AGK63044
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcuaccgguccggguacagcggcaucuucuccgucgagagcaagagcugcaucaaccgcugcuucuacguggagcuccugcgggggcgcaaggaggagaccgaggugcuguggaccuccaacagcaucgucguguucugcggcacguccggcaccuacgggaccggcagcuggccggacggggccgacaucaaccucaugcccaucuga

SEQ ID NO: 84460 - RNA, 1410 nt, Artificial Sequence
  derived and/or modified sequence opt1 from neuraminidase__InfluenzaA__AGK63046
augaaccccaaccagaagaucaucaccaucggcagcgugucccugaccaucagcacgaucugcuucuucaugcagaucgccauccucaucaccaccgucacccugcacuucaagcacuacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggaccugauccgcgggcggaaggaggagaccgaggugcucuggaccagcaacuccaucgucguguucugcggcacgagcgggaccuacggcaccggguccuggcccgacggcgccgacaucaaccugaugcccaucuga

SEQ ID NO: 84461 - RNA, 1398 nt, Artificial Sequence
  derived and/or modified sequence opt1 from neuraminidase__InfluenzaA__AGK82159
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgagacgauccacgaccgcucccaguaccgggcgcucaucagcuggccgcuguccagcccgcccaccguguacaacucccgcguggagugcaucggguggagcuccaccagcugccacgacggcaagucccggaugagcaucugcaucagcgggcccaacaacaacgccuccgccgucgugugguacaaccgccggcccguggccgagaucaacaccugggcgcgcaacauccugcggacgcaggagagcgagugcgucugccacaacggcgugugccccguggucuucaccgacggcuccgccaccgggcccgccgacacccgcaucuacuacuucaaggagggcaagauccucaagugggagagccugacggggaccgccaagcacaucgaggagugcuccugcuacggcgagcggaccggcaucacgugcacgugccgcgacaacuggcaggggagcaaccggcccgugauccagaucgacccgguggccaugacccacaccucccaguacaucugcagccccguccugaccgacaacccccgccccaacgacccgaacaucggcaagugcaacgaccccuaccccgggaacaacaacaacggcgugaagggguucuccuaccucgacggcgcgaacaccuggcugggccggaccaucagcaccgccucccgcagcggguacgagaugcugaaggugcccaacgcccucaccgacgaccgguccaagccgauccagggccagacgaucguccugaacgccgacuggagcggguacuccggcagcuucauggacuacugggccgagggggacugcuaccgcgcgugcuucuacguggagcugauccgcggccggcccaaggaggacaaggugugguggaccuccaacagcaucgucuccaugugcagcagcaccgaguuccucggccaguggaacuggcccgacggggccaagaucgaguacuuccuguga

SEQ ID NO: 84462 - RNA, 1398 nt, Artificial Sequence
  derived and/or modified sequence opt1 from neuraminidase__InfluenzaA__AGK84858
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgagggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccuguga

SEQ ID NO: 84463 - RNA, 1398 nt, Artificial Sequence
  derived and/or modified sequence opt1 from neuraminidase__InfluenzaA__AGK84861
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucaccaacauccagauggaggagcgcaccucccggaacuucaacaaccugaccaagggccucugcacgaucaacagcuggcacaucuacgggaaggacaacgccguccgcaucggcgaguccagcgacgugcuggugacccgggagcccuacgucuccugcgaccccgacgagugccgcuucuacgcccugagccagggcaccaccauccgggggaagcacuccaacggcacgauccacgaccgcagccaguaccgggcgcucaucuccuggccgcugagcuccccgcccaccguguacaacagccgcguggagugcaucgggugguccagcaccuccugccacgacggcaagagccggaugagcaucugcaucuccgggcccaacaacaacgccagcgccgucgugugguacaaccgccggcccguggccgagaucaacaccugggcgcgcaacauccugcggacgcaggaguccgagugcgucugccacaacggcgugugccccguggucuucaccgacggcagcgccaccgggcccgccgacacccgcaucuacuacuucaaggagggcaagauccucaagugggagucccugacggggaccgccaagcacaucgaggagugcagcugcuacggcgagcggaccggcaucacgugcacgugccgcgacaacuggcagggguccaaccggcccguggugcagaucgacccggucgccaugacccacaccagccaguacaucugcucccccgugcugaccgacaacccccgccccaacgacccgaacaucggcaagugcaacgaccccuaccccgggaucaacaacaacggcgugaagggguucagcuaccucgacggcgcgaacaccuggcugggccggaccaucuccaccgccagccgcuccggguacgagaugcugaagguccccaacgcccucaccgacgaccggagcaagccgauccagggccagacgaucgugcugaacgccgacugguccggguacagcggcuccuucauggacuacugggccgagggggacugcuaccgcgcgugcuucuacguggagcugauccgcggccggcccaaggaggacaaggucugguggaccagcaacuccaucgugagcaugugcagcuccaccgaguuccucggccaguggaacuggcccgacggggccaagaucgaguacuuccuguga

SEQ ID NO: 84464 - RNA, 1398 nt, Artificial Sequence; identical to SEQ ID NO: 84462
  derived and/or modified sequence opt1 from neuraminidase__InfluenzaA__AGK84864

SEQ ID NO: 84465 - RNA, 1398 nt, Artificial Sequence
  derived and/or modified sequence opt1 from neuraminidase__InfluenzaA__AGL95090
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaacaacauccagauggaggagcgcaccagccggaacuucaacaaccugaccaaggggcucugcaccaucaacuccuggcacaucuacggcaaggacaacgccguccgcaucggcgagagcuccgacgugcuggugacgcgggagcccuacgucagcugcgaccccgacgagugccgcuucuacgcccugucccaggggaccaccauccggggcaagcacagcaacgggaccauccacgaccgcucccaguaccgggcgcucaucagcuggccgcuguccagcccgcccacgguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacccaggagagcgagugcgucugccacaacggcgugugccccguggucuucacggacggguccgccaccggccccgccgacacccgcaucuacuacuucaaggaggggaagauccucaagugggagagccugaccggcacggccaagcacaucgaggagugcuccugcuacggcgagcggaccgggaucacgugcacgugcaaggacaacuggcagggcagcaaccgccccgugauccagaucgacccgguggccaugacccacaccucccaguacaucugcagccccguccugaccgacaacccccggcccaacgacccgaacaucgggaagugcaacgaccccuaccccggcaacaacaacaacggggugaagggcuucuccuaccucgacggcgcgaacaccuggcuggggcgcaccaucagcaccgccucccggagcggcuacgagaugcugaaggugcccaacgcccucaccgacgaccgcuccaagccgauccaggggcagaccaucguccugaacgccgacuggagcggcuacuccgggagcuucauggacuacugggccgagggcgacugcuaccgggcgugcuucuacguggagcugauccgcggccgccccaaggaggacaaggugugguggacguccaacagcaucgucuccaugugcagcagcaccgaguuccucgggcaguggaacuggcccgacggcgccaagaucgaguacuuccuguga

SEQ ID NO: 84466 - RNA, 1413 nt, Artificial Sequence; identical to SEQ ID NO: 77640
  derived and/or modified sequence opt1 from neuraminidase__InfluenzaA__AGL96802

SEQ ID NO: 84467 - RNA, 1413 nt, Artificial Sequence; identical to SEQ ID NO: 77640
  derived and/or modified sequence opt1 from neuraminidase__InfluenzaA__AGL96807

SEQ ID NO: 84468 - RNA, 1413 nt, Artificial Sequence
  derived and/or modified sequence opt1 from neuraminidase__InfluenzaA__AGL96808
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcuucuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 84469 - RNA, 1413 nt, Artificial Sequence
  derived and/or modified sequence opt1 from neuraminidase__InfluenzaA__AGL96809
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaagaccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacgacaacggcguguggaucgggcgcaccaaguccaaccggcugcgcaagggcuucgagaugaucugggaccccaacggguggaccaacaccgacagcgacuucuccgugaagcaggacgucguggcgaucacggacuggagcggcuacagcggguccuucgugcagcaccccgagcucaccggccuggacugcauccggcccugcuucugggucgagcuggugcgcggccucccgcgggagaacaccaccaucuggacgagcggguccagcaucuccuucugcggcgucaacagcgacaccgccaacugguccuggcccgacggggccgagcugcccuucaccaucgacaaguga

SEQ ID NO: 84470 - RNA, 1413 nt, Artificial Sequence; identical to SEQ ID NO: 77640
  derived and/or modified sequence opt1 from neuraminidase__InfluenzaA__AGL96818

SEQ ID NO: 84471 - RNA, 1413 nt, Artificial Sequence
  derived and/or modified sequence opt1 from neuraminidase__InfluenzaA__AGL96820
augaaccccaaccagaagaucaucaccaccggcagcaucuccaucgccaucgggaucaucagccugaugcuccagaucggcaacaucaucuccaucugggccagccacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacgacaacggcguguggaucgggcgcaccaaguccaaccggcugcgcaagggcuucgagaugaucugggaccccaacggguggaccaacaccgacagcgacuucuccgugaagcaggacgucguggccaucacggacuggagcggcuacagcggguccuucgugcagcaccccgagcucaccggccuggacugcauccggcccugcuucugggucgagcuggugcgcggccucccgcgggagaacaccaccaucuggacgagcggguccagcaucuccuucugcggcgucaacagcgacaccgccaacugguccuggcccgacggggccgagcugcccuucaccaucgacaaguga

SEQ ID NO: 84472 - RNA, 1413 nt, Artificial Sequence
  derived and/or modified sequence opt1 from neuraminidase__InfluenzaA__AGL96821
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugagcguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacuggagcggcuacuccgggagcuucgugcagcaccccgagcucaccggccuggacugcauccggcccugcuucugggucgagcuggugcgcggccucccgcgggagaacacgaccaucuggaccuccgggagcuccaucagcuucugcggcgucaacuccgacaccgccaacuggagcuggcccgacggggccgagcugcccuucacgaucgacaaguga

SEQ ID NO: 84473 - RNA, 1410 nt, Artificial Sequence
  derived and/or modified sequence opt1 from neuraminidase__InfluenzaA__AGN69269
augaucaccaaccagcgcaucaucaccaucggcacggugugccugaucgucgggaucgugagccuccugcugcagaucggcaacaucgugucccucuggaucagccacuccauccagaccggggagaagaaccacagcgagaucugcaaccagaacaccaucaccuacgagaacaacacgugggucaaccagaccuacgugaacaucuccaacaccaacaucgccgacggccagggggugaccagcaucauccuggccggcaacuccagccugugccccaucuccggcugggcgaucuacagcaaggacaacuccauccggaucgggagcaagggcgacaucuucgucauccgcgagccguucaucuccugcagccaccucgagugccggacguucuuccugacccagggggcccugcucaacgaccgccacuccaacggcaccgugaaggaccggagccccuaccgcacccugauguccugccccaucggggaggcccccagcccguacaacucccgguucgagagcguggccuggagcgccuccgcgugccacgacggcaugggcuggaucacgaucgggaucagcggccccgacaacggggccgucgccgugcugaaguacaacggcaucaucaccgacaccaucaaguccuggcgcaacaagauccuccggacccaggagagcgagugcgugugcaucaacggcuccugcuucacgaucaugaccgacgggcccagcaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccuggacuaccagaucggguacaucugcagcggcguguucggcgacaacccccgcuccaacgacgggaagggcaacugcgggcccgcccucagcaacggcgccaacggggucaagggcuucuccuuccgguacggcaacgggguguggaucggccgcaccaagagcaucuccagccgguccggguucgagaugaucugggacccgaacggcuggacggagaccgacagcagcuucuccaugaagcaggacaucaucgcccugaccgacuggagcggguacuccggcagcuucgugcagcaccccgagcugaccggcaugaacugcauccgccccugcuucugggucgagcucauccgggggcagcccaaggaguccacgaucuggaccagcggcuccagcaucuccuucugcgggguggacagcgagaccgcguccuggagcuggccggacggcgccgaccugcccuucaccaucgacaaguga

SEQ ID NO: 84474 - RNA, 1410 nt, Artificial Sequence
  derived and/or modified sequence opt1 from neuraminidase__InfluenzaA__AGN69280
augaacaccaaccagcgcaucaucaccaucggcacggugugccugaucgucgggaucgugagccuccugcugcagaucggcaacaucgugucccucuggaucagccacuccauccagaccggggagaagaaccacagcgagaucugcaaccagaacaccaucaccuacgagaacaacacgugggucaaccagaccuacgugaacaucuccaacaccaacaucgccgacggccagggggugaccagcaucauccuggccggcaacuccagccugugccccaucuccggcugggcgaucuacagcaaggacaacuccauccggaucgggagcaagggcgacaucuucgucauccgcgagccguucaucuccugcagccaccucgagugccggacguucuuccugacccagggggcccugcucaacgaccgccacuccaacggcaccgugaaggaccggagccccuaccgcacccugauguccugccccaucggggaggcccccagcccguacaacucccgguucgagagcguggccuggagcgccuccgcgugccacgacggcaugggcuggcugacgaucgggaucagcggccccgacaacggggccgucgccgugcucaaguacaacggcaucaucaccgacaccaucaaguccuggcgcaacaagauccugcggacccaggagagcgagugcgugugcaucaacggcuccugcuucacgaucaugaccgacgggcccagcaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccucgacuaccagaucggguacaucugcagcggcguguucggcgacaacccccgcuccaacgacgggaagggcaacugcgggcccguccugagcaacggcgccaacggggugaagggcuucuccuuccgguacggcaacgggguguggaucggccgcaccaagagcaucuccagccgguccggguucgagaugaucugggacccgaacggcuggacggagaccgacagcagcuucuccaugaagcaggacaucaucgcccugaccgacuggagcggguacuccggcagcuucguccagcaccccgagcucaccggcaugaacugcauccgccccugcuucuggguggagcugauccgggggcagcccaaggaguccacgaucuggaccggcgggagcuccaucagcuucugcggcguggacuccgagaccgccagcugguccuggccggacggcgcggaccugcccuucaccaucgacaaguga

SEQ ID NO: 84475 - RNA, 1410 nt, Artificial Sequence
  derived and/or modified sequence opt1 from neuraminidase__InfluenzaA__AGN69292
augaaccccaaccagaagaucaucaccaucggcagcaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacaucuccaacacgaacuucguggccgagcaggcggucgccagcgugaagcuggccgggaacuccagccugugccccguguccggcugggccaucuacagcaaggacaacuccguccgcaucgggagcaagggcgacguguucgugauccgggagcccuucaucuccugcagccaccucgagugccgcaccuucuuccugacccagggcgcccugcucaacgacaagcacuccaacgggaccaucaaggaccggagccccuaccgcacgcugauguccugcccgaucggcgagguccccagccccuacaacucccgguucgagagcguggcguggagcgccuccgccugccacgacgggaccagcuggcugaccaucggcaucuccgggcccgacaacggcgccguggcgguccucaaguacaacggcaucaucaccgacacgaucaagagcuggcgcaagaacauccugcggacccaggaguccgagugcgccugcgugaacgggagcugcuucaccgugaugaccgacggcccguccaacgggcaggccagcuacaaggucuucaagaucgagaagggcaagguggugaaguccgucgagcugaacgcccccaacuaccacuacgaggagugcagcugcuaccccgaguccggcgagaucacgugcgugugccgcgacaacuggcacgggagcaaccggcccuggguguccuucaaccagaaccucgaguaccagaugggcuacaucugcagcgggaucuucggcgacaacccgcgccccaacgacaagaccggguccugcggccccgucuucagcaacggcgccaacggggugaagggcuucuccuucaaguacgggaacggcguguggaucgggcggaccaagagcaucuccagccgcaugggcuucgagaugaucugggaccccgacggcuggaccaagacggacgacaaguucagcgucaagcaggacaucaucgggaucaacgacugguccggcuacagcggguccuucgugcagcacccggagcugaccggccuggacugcaugcggcccugcuucugggucgagcucauccgcgggcggcccaaggagaacaccaucuggaccagcggcuccagcaucuccuucugcggcgugaacagcgacacgguggggugguccuggcccgacggcgcggagcugccguucaccaucgacaaguga

SEQ ID NO: 84476 - RNA, 1410 nt, Artificial Sequence
  derived and/or modified sequence opt1 from neuraminidase__InfluenzaA__AGN69316
augaaccccaaccagaagaucaucaccaucggcagcaucugcaugaccaucgggaucgccucccugauccuccagaucggcaacaucaucagcaucuggaucucccacagcauccagacggagaaccagaaccagccggagaucugcaaccagaacgugaucaccuacgagaacaacaccugggucaaccagaccuacgugaacaucuccaacacgaacuucguggccgagcaggcggucgccagcgugaagcuggccgggaacuccagccugugccccguguccggcugggccaucuacagcaaggacaacuccguccgcaucgggagcaagggcgacguguucgugauccgggagcccuucaucuccugcagccaccucgagugccgcaccuucuuccugacccagggcgcccugcucaacgacaagcacuccaacgggaccaucaaggaccggagccccuaccgcacgcugauguccugcccgaucggcgagguccccagccccuacaacucccgguucgagagcguggcguggagcgccuccgccugccacgacgggaccagcuggcugaccaucggcaucuccgggcccgacaacggcgccguggcgguccucaaguacaacggcaucaucaccgacacgaucaagagcuggcgcaagaacauccugcggacccaggaguccgagugcgccugcgugaacgggagcugcuucaccgugaugaccgacggcccguccaacgggcaggccagcuacaaggucuucaagaucgagaagggcaagguggugaagacggucgagcugaacgcccccaacuaccacuacgaggagugcuccugcuaccccgagagcggcgagaucacgugcgugugccgcgacaacuggcacggguccaaccggcccugggugagcuucaaccagaaccucgaguaccagaugggcuacaucugcuccgggaucuucggcgacaacccgcgccccaacgacaagaccgggagcugcggccccgucuucuccaacggcgccaacggggugaagggcuucagcuucaaguacgggaacggcguguggaucgggcggaccaaguccaucagcucccgcaugggcuucgagaugaucugggaccccgacggcuggaccaagaccgacgacaaguucagcgucaagcaggacaucaucgggaucaacgacuggagcggcuacuccgggagcuucgugcagcacccggagcugaccggccuggacugcaugcggcccugcuucugggucgagcucauccgcgggcggcccaaggagaacaccaucuggacguccggcagcuccaucagcuucugcggcgugaacuccgacaccgugggguggagcuggcccgacggcgcggagcugccguucaccaucgacaaguga

SEQ ID NO: 84477 - RNA, 1410 nt, Artificial Sequence; identical to SEQ ID NO: 84476
  derived and/or modified sequence opt1 from neuraminidase__InfluenzaA__AGN69328

SEQ ID NO: 84478 - RNA, 1410 nt, Artificial Sequence
  derived and/or modified sequence opt1 from neuraminidase__InfluenzaA__AGN69340
augaaccccaaccagaagaucaucaccaucggccugaucugcaugaccaucgggaucgccagccucauccugcagaucggcaacaucaucuccaucuggaucagccacuccauccagacggagaaccagaacaagccggagaucugcaaccagaacgugaucaccuacgagaacaacaccugggucaaccagaccuacgugaacgugagcaacacgaacuucgucgccgagcaggcgguggccuccgugaagcuggucgggaacagcucccucugccccgugagcggcugggccaucuacuccaaggacaacagcgugcgcaucggguccaagggcgacgucuucgugauccgggagcccuucaucagcugcucccaccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgaguccgucgccuggagcgcgagcgccugccacgacgggaccuccuggcucaccaucggcaucagcgggcccgacaacggcgccguggccgugcugaaguacaacggcaucaucaccgacacgaucaaguccuggcgcaagaacauccugcggacccaggagagcgagugcgcgugcgucaacggguccugcuucaccgugaugaccgacggcccgagcaacgggcaggccuccuacaagguguucaagaucgagcgcggcaaggucgucaagagcguggagcucaacgcccccaacuaccacuacgaggagugcuccugcuaccccgagagcuccgagaucacgugcgugugccgggacaacuggcacggcagcaaccgccccuggguguccuucaaccagaaccuggaguaccagaugggguacaucugcagcggcguguucggggacaacccgcggcccaacgacaagaccggcuccugcgggcccgucuucagcaacggcgccaacggcgugaagggguucuccuucaaguacggcaacggggucuggaucggccgcaccaagagcaccuccagccggaugggguucgagaugaucugggaccccgacggcuggacgaagaccgacgacaaguucagcgugaagcaggacaucaucggcaucaccgacugguccggguacagcggcuccuucgugcagcacccggagcugaccgggcucgacugcaugcgccccugcuucugggucgagcugauccggggccgccccaaggagaacacgaucuggaccagcggguccagcaucuccuucugcggcgugaacagcgacaccgugggcugguccuggcccgacggggccgagcugccguucaccaucgacaaguga

SEQ ID NO: 84479 - RNA, 1410 nt, Artificial Sequence
  derived and/or modified sequence opt1 from neuraminidase__InfluenzaA__AGO00268
augaaccccaaccagaagaucaucaccaucggcagcaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucagcaacacgaacgucguggccgggaaggacaccaccuccaugauccuggccggcaacagcucccugugcccgauccgcggcugggcgaucuacagcaaggacaacgggauccggaucggcuccaagggggacguguucgucauccgcgagcccuucaucagcugcucccaccucgagugccggaccuucuuccugacgcagggcgcccugcucaacgacaagcacagcaacgggaccgugaaggaccgcucccccuaccgggcccugaugagcugccccgugggcgaggccccgucccccuacaacagccgcuucgagagcgucgccugguccgcgagcgccugccacgacggcaugggguggcugaccaucggcaucuccgggcccgacgacggcgccguggccgugcucaaguacaacggcaucaucaccgagacgaucaagagcuggaagaagaagauccugcggacccaggaguccgagugcgucugcgugaacgggagcugcuucaccaucaugaccgacggccccuccgacgggccggcgagcuacaagaucuucaagaucgagaagggcaaggugacgaaguccaucgagcuggacgcccccaacagccacuacgaggagugcuccugcuaccccgacaccgggaaggucaugugcgugugccgcgacaacuggcacggcagcaaccggcccuggguguccuucgaccagaaccucgacuaccagaucggcuacaucugcagcggggucuucggcgacaacccgcgccccaaggacgggaagggcuccugcgggcccguguacguggacggcgccaacggcgucaagggguucagcuaccgguacggcgacgggguguggaucggccgcaccaaguccaacagcucccggcagggguucgagaugaucugggaccccaacggcuggaccgagacggacagcagcuucuucgugaagcaggacgucguggccaugaccgacugguccggcuacagcggguccuucguccagcacccggagcugaccggccugaacugcaugcgccccugcuucuggguggagcucauccgggggcgccccaaggagaagaccaucuggacgagcggcuccagcaucuccuucugcggcgugaacagcgacaccgucgacugguccuggcccgacggggccgagcugccguucaccaucgacaaguga

SEQ ID NO: 84480 - RNA, 1410 nt, Artificial Sequence
  derived and/or modified sequence opt1 from neuraminidase__InfluenzaA__AGO00280
augaaccccaaccagaagaucaucaccaucggcagcaucugcaugguggucgggaucaucucccugauccuccagaucggcaacaucgugagcaucuggaucucccacagcauccagaccgggaaccagaaccacacggggaccugcaaccaguccaucaucaccuacaagaacagcaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcagcaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgagccccuacaacucccgcuucgagagcgucgccuggagcgcguccgccugccacgacggcaugggguggcugaccaucggcaucagcgggcccgacgacggcgccguggccgugcucaaguacaacggcaucaucacggagaccaucaaguccuggcggaaggagauccugcgcacccaggagagcgagugcgucugcgugaacggguccugcuucaccaucaugacggacggccccagcgggggcccggcguccuacaagaucuucaagaucgagaaggggaaggugaccaagagcaucgagcuggacgcccccaacucccacuacgaggagugcagcugcuaccccgacaccuccaaggucaugugcgugugccgggacaacuggcacggcagcaaccgccccuggguguccuucgaccagaaccucgacuaccagaugggcuacaucugcagcggggucuucggcgacaacccgcggcccaaggacgggaagggcuccugcgggcccguguacguggacggcgccaacggcgucaagggguucagcuaccgcuacggcaacgggguguggaucggccggaccaaguccaacagcucccgccagggguucgagaugaucugggaccccaacggcuggacggagaccgacagcaacuucuucaugaagcaggacgucguggccgugaccgacuggagcggcuacuccgggagcuucguccagcacccggagcugaccggccuggacugcaugcggcccugcuucuggguggagcucauccgcgggcggcccaaggagaacacgaucuggaccuccggcagcuccaucagcuucugcggcgugaacuccgacaccgucgacuggagcuggcccgacggggccgagcugccguucaccaucgacaaguga

SEQ ID NO: 84481 - RNA, 1413 nt, Artificial Sequence
  derived and/or modified sequence opt1 from neuraminidase__InfluenzaA__AGO00292
augaaccccaaccagaagaucaucaccaucggcagcaucugcaugaccaucgggacgaucucccugauccuccagaucggcaacaucaucagcaucuggaucucccacagcauccagaccgggucccagaaccacaccggcaucugcaaccagcgcaucaucaccuacgagaacaacacgugggugaaccagaccuacgucaacaucagcaacaccaacgugguggccgggaaggacaccacguccaugauccuggccggcaacagcucccugugcccgauccggggcugggcgaucuacagcaaggacaacuccauccgcaucgggagcaagggcgacgucuucgugauccgggagcccuucaucuccugcagccaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagagcgucgccuggagcgcguccgccugccacgacggcaugggcuggcugacgaucgggaucagcggccccgacgacggggccguggccgugcucaaguacaacggcaucaucaccgagaucaucaaguccuggcgcaagcagauccugcggacccaggagagcgagugcgucugcgugaacggcuccugcuucaccaucaugacggacgggcccagcgacggcccggcguccuaccgcaucuucaagaucgagaaggggaagaucaccaagagcaucgagcuggacgcccccaacucccacuacgaggagugcagcugcuaccccgacaccggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggagcugcgaccccgucaacguggacggcgccgacggggugaagggcuucuccuaccgcuacggcgacggggucuggaucggccggaccaagagcaacuccagccgcaagggguucgagaugaucugggaccccaacggcuggacggacaccgacgacaacuuccuggugaagcaggacguggucgccaugaccgacugguccggguacagcggcagcuucgugcagcacccggagcugaccggccucgacugcauccggcccugcuucuggguggagcugauccgcgggcggccccgcgagaagacgaccaucuggaccuccggcagcuccaucagcuucugcggggucaacuccgacaccgugaacuggagcuggcccgacggcgccgagcugccguucacgaucgacauguga

SEQ ID NO: 84482 - RNA, 1413 nt, Artificial Sequence
  derived and/or modified sequence opt1 from neuraminidase__InfluenzaA__AGO00304
augaaccccaaccagaagaucaucaccaucggcagcaucugcauggccaucgggaccaucucccugauccuccagaucggcaacaucaucagcaucuggaucucccacagcauccagacggggucccagaaccacaccggcaucugcaaccagcgcaucaucaccuacgagaacaacaccugggugaaccagacguacgucaacaucagcaacaccaacgugguggccgggaaggacaccaccuccaugauccuggcgggcaacacgagccugugcccgauccggggcugggccaucuacuccaaggacaacagcauccgcaucggguccaagggcgacgucuucgugauccgggagcccuucaucagcugcucccaccucgagugccgcaccuucuuccugacccagggggcccugcucaacgacaagcacagcaacggcaccgugaaggaccggucccccuaccgcgcccugaugagcugccccaucggggaggccccgucccccuacaacagccgguucgaguccgucgcguggagcgccagcgccugccacgacggcaugggcuggcugacgaucgggaucuccggccccgacgacggggccguggcggugcucaaguacaacggcaucaucaccgagaucaucaagagcuggcgcaagcagauccugcggacccaggaguccgagugcgucugcgugaacggcagcugcuucaccaucaugacggacgggcccuccaacggcccggccagcuaccgcaucuucaagaucgagaaggggaagaucaccaaguccaucgagcuggacgcccccaacagccacuacgaggagugcuccugcuaccccgacaccggcaaggugaugugcgucugccgggacaacuggcacgggagcaaccgccccuggguguccuucaaccagaaccucgacuaccagaucggcuacaucugcagcggcguguucggggacaacccgcggcccaaggacggcaagggguccugcgaccccgucaacguggacggcgccgacggggugaagggcuucagcuaccgcuacggcaacggggucuggaucggccggaccaaguccaacagcucccgcaagggguucgagaugaucugggaccccaacggcuggacgaacaccgacgggaacuucagcgugaagcaggacguggucgccaugaccgacugguccggcuacagcggcagcuucgugcagcacccggagcugaccgggcuggacugcaugcggcccugcuucuggguggagcucauccgcggccggccccgcgagaagacgaccaucuggaccuccgggagcuccaucagcuucugcggcgucaacuccgacaccgugaacuggagcuggcccgacggcgcggagcugccguucacgaucgacaaguga

SEQ ID NO: 84483 - RNA, 1410 nt, Artificial Sequence; identical to SEQ ID NO: 83552
  derived and/or modified sequence opt1 from neuraminidase__InfluenzaA__AGO00316

SEQ ID NO: 84484 - RNA, 1410 nt, Artificial Sequence; identical to SEQ ID NO: 82996
  derived and/or modified sequence opt1 from neuraminidase__InfluenzaA__AGO00328

SEQ ID NO: 84485 - RNA, 1410 nt, Artificial Sequence; identical to SEQ ID NO: 75103
  derived and/or modified sequence opt1 from neuraminidase__InfluenzaA__AGO00340

SEQ ID NO: 84486 - RNA, 1365 nt, Artificial Sequence; identical to SEQ ID NO: 76727
  derived and/or modified sequence opt1 from neuraminidase__InfluenzaA__AGO00352

SEQ ID NO: 84487 - RNA, 1365 nt, Artificial Sequence; identical to SEQ ID NO: 76727
  derived and/or modified sequence opt1 from neuraminidase__InfluenzaA__AGO00376

SEQ ID NO: 84488 - RNA, 1365 nt, Artificial Sequence; identical to SEQ ID NO: 76727
  derived and/or modified sequence opt1 from neuraminidase__InfluenzaA__AGO00388

SEQ ID NO: 84489 - RNA, 1365 nt, Artificial Sequence; identical to SEQ ID NO: 76727
  derived and/or modified sequence opt1 from neuraminidase__InfluenzaA__AGO00400

SEQ ID NO: 84490 - RNA, 1365 nt, Artificial Sequence; identical to SEQ ID NO: 76727
  derived and/or modified sequence opt1 from neuraminidase__InfluenzaA__AGO00412

SEQ ID NO: 84491 - RNA, 1365 nt, Artificial Sequence; identical to SEQ ID NO: 76727
  derived and/or modified sequence opt1 from neuraminidase__InfluenzaA__AGO00424

SEQ ID NO: 84492 - RNA, 1365 nt, Artificial Sequence
  derived and/or modified sequence opt1 from neuraminidase__InfluenzaA__AGO00436
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagcaacuacgaggagugcuccugcuaccccgacacggggaaggucaugugcgugugccgggacaacuggcacggcagcaaccgccccuggguguccuucgaccagaaccucgacuaccagaucggguacaucugcagcggcgucuucggcgacaacccccggccggaggacgggaccggcuccugcgggcccguguacguggacggcgccaacggggucaagggcuucagcuaccgcuacggcaacgggguguggaucggccggaccaagucccacagcucccgccacggguucgagaugaucugggaccccaacggcuggaccgagacggacagcaaguucagcgugcggcaggacgucguggccaugaccgacugguccggguacagcggcuccuucgugcagcaccccgagcugaccggccuggacugcaugcgcccgugcuucugggucgagcucauccgggggcgccccaaggagaagaccaucuggacgagcgccuccagcaucuccuucugcggcgugaacagcgacaccgucgacugguccuggcccgacggggccgagcugcccuucagcaucgacaaguga

SEQ ID NO: 84493 - RNA, 1365 nt, Artificial Sequence
  derived and/or modified sequence opt1 from neuraminidase__InfluenzaA__AGO00448
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuaccggaucuucaagaucgagaagggcaaggugaccaaguccaucgagcugaacgcgccgaacagccacuacgaggagugcuccugcuaccccgacacggggaaggucaugugcgugugccgcgacaacuggcacggcagcaaccggcccuggguguccuucgaccagaaccucgacuaccagaucggguacaucugcagcggcgucuucggcgacaacccccgcccggaggacgggaccggcuccugcgggcccguguacguggacggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguacagcggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaaguga

SEQ ID NO: 84494 - RNA, 1410 nt, Artificial Sequence
  derived and/or modified sequence opt1 from neuraminidase__InfluenzaA__AGQ47722
augaacaccaaccagcgcaucaucaccaucggcacgaucugccugaucguggggaucaucagccuccugcugcagaucggcaacaucaucucccucuggaucagccacuccauccagaccggggagaagucccaccccgagaucugcaaccagagcgucaucaccuacgagaacaacaccugggugaaccagacguacgugaacaucagcaacaccaacaucgccgccggccagggggucaccccgaucauccuggcgggcaacuccagccugugccccaucuccggcugggccaucuacagcaaggacaacuccauccggaucgggagcaagggcgacaucuucgugaugcgcgagcccuucaucuccugcagccaccucgagugccggaccuucuuccugacgcagggggcccugcucaacgaccgccacuccaacggcaccgugaaggaccggagccccuaccgcacccugauguccugcccgaucggggaggcccccagccccuacaacucccgguucgagagcgucgccuggagcgcguccgccugccacgacggcaugggcuggcugaccaucgggaucagcggccccgacaacggggccguggccgugcucaaguacaacggcaucaucacggacaccaucaaguccuggcgcaacaagauccugcggacccaggagagcgagugcgucugcaucaacggcuccugcuucaccaucaugacggacgggccgagcaacggccaggcguccuacaagaucuucaagauggagaaggggaagaucaucaagagcaucgagcuggacgcccccaacuaccacuacgaggagugcuccugcuaccccgacaccggcaaggugaugugcgugugccgcgacaacuggcacgccagcaaccggcccugggucuccuucgaccagaaccucgacuaccagaucggguacaucugcagcggcguguucggcgacaacccgcgcuccaacgacgggaagggcaacugcgggcccgugcugagcaacggcgccaacggggucaagggcuucuccuuccgguacggcaacgggguguggaucggccgcaccaagagcaucuccagccgguccggguucgagauggugugggaccccaacggcuggaccgagacggacagcagcuucuccaugaagcaggacaucaucgcccugaccgacuggagcggguacuccggcagcuucguccagcaccccgagcucaccggcaugaacugcauccgcccgugcuucuggguggagcugauccgggggcagcccaaggaguccaccaucuggacgagcggcuccagcaucuccuucugcggggugaacagcggcaccgcguccuggagcuggcccgacggcgccgaccugcccuucaccaucgacaaguga

SEQ ID NO: 84495 - RNA, 1413 nt, Artificial Sequence; identical to SEQ ID NO: 77461
  derived and/or modified sequence opt1 from neuraminidase__InfluenzaA__AGQ47731

SEQ ID NO: 84496 - RNA, 1377 nt, Artificial Sequence
  derived and/or modified sequence opt1 from neuraminidase__InfluenzaA__AGQ47743
augaaccccaaccagaagaucaucaccaucggcagcaucugcaugguggucgggaucaucucccugauccuccagaucggcaacaucaucagcaucuggaucucccacagcauccagaccgggaaccagaaccacaagaacuccacguggaugaaccagaccuacaucaacaucagcaacaccaacgugguggccggccaggacuccaccagcgucauccugacggggaacuccagccugugcccgauccgcggcugggccaucaacuccaaggacaacggcauccggaucgggagcaagggcgacguguucgugauccgcgagcccuucaucuccugcagccaccucgagugccggaccuucuuccugacccagggggcgcugcucaacgacaagcacuccaacggcaccgucaaggaccgcagccccuaccgggcccugauguccugccccgugggggaggccccgagccccuacaacucccgcuucgagagcguggccuggagcgccuccgcgugccacgacggcaugggcuggcugacgaucgggaucagcggccccgacaacggggccgucgccgugcucaaguacaacggcaucaucaccgagaccaucaaguccuggcggaagaagauccugcgcacccaggagagcgagugcacgugcgugaacggcuccugcuucaccaucaugaccgacgggcccagcaacggccuggccuccuacaagaucuucaagaucgagaaggggaaggucaccaagagcaucgagcucaacgcgccgaacucccacuacgaggagugcagcugcuaccccgacacgggcaaggugaugugcgugugccgggacaacuggcacggguccaaccgccccugggucagcuucgaccagaaccuggacuaccagaucggcuacaucugcuccggcguguucggggacaacccccggccgaaggacggcaccgggagcugcggccccguguccgccgacggggccaacggcgucaagggcuucagcuaccgcuacgggaacggcguguggaucgggcggaccaaguccaacagcucccgccacggcuucgagaugaucugggaccccaacggguggaccgagacggacagccgguucagcgugcgccaggacgucguggccaugaccgaccgguccggcuacagcggcuccuucgugcagcaccccgagcugaccgggcucgacugcaugcgcccgugcuucugggucgagcugauccggggccgccccgaggaggagaccaucuggacgagcggguccaucaucagcuucugcggcgugaacuccgacaccgucgacuggagcuggcccgacggcgccgagcugcccuucaccaucgacaaguga

SEQ ID NO: 84497 - RNA, 1413 nt, Artificial Sequence
  derived and/or modified sequence opt1 from neuraminidase__InfluenzaA__AGQ47755
augaaccccaaccagaagaucaucaccaucggcagcaucugcauggccaucgggaccaucucccugauccuccagaucggcaacaucaucagcaucuggaucucccacagcauccagacggggucccagaaccacaccggcaucugcaaccgccggaucgugaccuacgagaacaacaccugggucaaccagacguacgugaacaucagcaacaccaacguggucgccgagaaggacaccaccuccaugauccuggcggggaacagcucccugugcccgauccgcggcugggccaucuacagcaaggacaacuccauccggaucggcagcaagggggacguguucgugauccgcgagcccuucaucuccugcagccaccucgagugccggacguucuuccugacccagggcgcccugcucaacgacaagcacuccaacgggaccgucaaggaccgcagccccuaccgggcccugauguccugccccaucggcgaggccccgagccccuacaacucccgcuucgagagcguggcguggagcgccuccgccugccacgacgggaugggcuggcugaccaucggcaucagcgggcccgacgacggcgccguggcgguccucaaguacaacgggaucaucacggagaucaucaaguccuggcggaagcagauccugcgcacccaggagagcgagugcgugugcgugaacggcuccugcuucaccaucaugaccgacggccccagcaacgggccggccuccuaccggaucuucaagaucaagaagggcaagaucaccaagagcaucgagcuggacgcccccaacucccacuacgaggagugcagcugcuaccccgacacggggaaggucaugugcgugugccgcgacaacuggcacggcuccaaccggcccugggugagcuucaaccagaaccucgacuaccagaucggguacaucugcuccggcgucuucggcgacaacccgcgccccaaggacgggaagggcagcugcgaccccgugaacguggacggggccgacggcgucaagggguucuccuaccgguacggcaacggcguguggaucgggcgcaccaagagcaccuccagccggaagggcuucgagaugaucugggaccccaacggguggacggacaccgacggcaacuuccuggugaagcaggacgucguggccaugaccgacugguccggguacagcggcagcuucgugcagcacccggagcugaccggccucgacugcaugcgccccugcuucugggucgagcugauccgggggcgcccccgggagaagacgaccaucuggaccuccggcagcuccaucagcuucugcggggugaacuccgacaccgucaacuggagcuggcccgacggcgcggagcugccguucacgaucgacaaguga

SEQ ID NO: 84498 - RNA, 1410 nt, Artificial Sequence
  derived and/or modified sequence opt1 from neuraminidase__InfluenzaA__AGQ47767
augaaccccaaccagaagaucaucaccaucggcagcaucugcaugguggucgggaucaucucccugauccuccagaucggcaacaucgugagcaucuggaucucccacagcauccagaccgggaaccagaaccacacggggaccugcgaccaguccaucaucaccuacaagaacagcaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcagcaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgagccccuacaacucccgcuucgagagcgucgccuggagcgcguccgccugccacgacggcaugggguggcugaccaucggcaucagcgggcccgacgacggcgccguggccgugcucaaguacaacggcaucaucacggagaccaucaaguccuggcggaaggagauccugcgcacccaggagagcgagugcgucugcgugaacggguccugcuucaccaucaugacggacggccccagcgggggcccggcguccuacaagaucuucaagaucgagaaggggaaggugaccaagagcaucgagcuggacgcccccaacucccacuacgaggagugcagcugcuaccccgacaccuccaaggucaugugcgugugccgggacaacuggcacggcagcaaccgccccuggguguccuucgaccagaaccucgacuaccagaugggcuacaucugcagcggggucuucggcgacaacccgcggcccaaggacgggaagggcuccugcgggcccguguacguggacggcgccaacggcgucaagggguucagcuacaaguacggcaacgggguguggaucggccgcaccaaguccaacagcucccggcagggguucgagaugaucugggaccccaacggcuggacggagaccgacagcaacuucuucaccaagcaggacgucguggccgugaccgacuggagcggcuacuccgggagcuucguccagcacccggagcugacgggccuggacugcaugcgccccugcuucuggguggagcucauccgggggcgccccaaggagaacaccaucuggaccuccggcagcuccaucagcuucugcggcgugaacuccgacaccgucgacuggagcuggcccgacggggccgagcugccguucacgaucgacaaguga

SEQ ID NO: 84499 - RNA, 1410 nt, Artificial Sequence; identical to SEQ ID NO: 84480
  derived and/or modified sequence opt1 from neuraminidase__InfluenzaA__AGQ47779

SEQ ID NO: 84500 - RNA, 1413 nt, Artificial Sequence
  derived and/or modified sequence opt1 from neuraminidase__InfluenzaA__AGQ47791
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacaacaccugggucaaccagacccacgugaacaucagcaacacgaacguggucgccgggaaggacaccaccuccaugauccuggcgggcaacagcucccugugcccgauccggggcugggccaucuacagcaaggacaacuccauccgcaucgggagcaagggcgacguguucgugauccgggagcccuucaucuccugcagccaccucgagugccgcaccuucuuccugacgcagggggcccugcucaacgacaagcacuccaacggcaccgucaaggaccggagccccuaccgcgcccugauguccugccccaucggggaggccccgagccccuacaacucccgguucgagagcguggcguggagcgccuccgccugccacgacggcaugggcuggcugaccaucgggaucagcggccccgacgacggggccguggcgguccucaaguacaacggcaucaucaccgagacgaucaaguccuggaagaagcagauccugcgcacccaggagagcgagugcgugugcgugaacggcuccugcuucaccaucaugaccgacgggcccagcgacggcccggccuccuaccggaucuucaagaucgagaaggggaagaucaccaagagcaucgagcuggacgcccccaacucccacuacgaggagugcagcugcuaccccgacacgggcaccgucaugugcgugugccgcgacaacuggcacggguccaaccggcccugggugagcuucaaccagaaccucgacuaccagaucggcuacaucugcuccggcgucuucggggacaacccgcgccccaaggacggcaaggggagcugcgaccccgugaacguggacggcgccgacggggucaagggcuucuccuaccgguacggcaacgggguguggaucggccgcaccaagagcaacuccagccggaagggguucgagaugaucugggaccccaacggcuggacggacaccgacgggaacuuccuggugaagcaggacgucguggccaugaccgacugguccggcuacagcggcagcuucgugcagcacccggagcugaccgggcucgacugcaugcgccccugcuucugggucgagcugauccggggccgcccccgggagaagacgaccaucuggaccuccgggagcuccaucagcuucugcggcgugaacuccgacaccgucaacuggagcuggcccgacggcgcggagcugccguucacgaucgacaaguga

SEQ ID NO: 84501 - RNA, 1410 nt, Artificial Sequence
  derived and/or modified sequence opt1 from neuraminidase__InfluenzaA__AGQ47803
augaaccccaaccagaagaucaucaccaucggcagcaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucagcaacacgaacgucguggccgggaagggcaccaccuccgugauccuggccggcaacagcucccugugcccgauccgcgggugggcgaucuacagcaaggacaacggcauccggaucggguccaagggcgacgucuucgugauccgcgagcccuucaucagcugcucccaccucgagugccggaccuucuuccugacgcagggggcccugcucaacgacaagcacagcaacggcaccgugaaggaccgcucccccuaccgggcccugaugagcugccccgucggcgaggccccgucccccuacaacagccgcuucgagagcguggccugguccgcgugcgccugccacgacgggaugggcuggcugaccaucgggaucagcggccccgacgacgaggccguggccguccucaaguacaacggcaucaucaccgagacgaucaaguccuggcggaagaagauccugcgcacccaggagagcgagugcgugugcgugaacggguccugcuucaccaucaugaccgacggccccagcgacgggccggcguccuacaagaucuucaagaucgagaagggcaaggucaccaagagcaucgagcuggacgcccccaacucccacuacgaggagugcagcugcuaccccgacacggggaaggugaugugcgugugccgggacaacuggcacggcuccaaccgccccugggucagcuucgaccagaaccucgacuaccagaucggcuacaucugcuccgggguguucggcgacaacccgcggcccaaggacgggaagggcagcugcgggcccguguacgucgacggcgccaacggcgugaagggguucuccuaccgcuacggcaacgggguguggaucggccggaccaagagcgacuccagccgccagggguucgagaugaucugggaccccaacggcuggaccgagacggacuccaacuucuucgucaagcaggacaucguggccaugaccgacuggagcggcuacagcggguccuucguccagcacccggagcugaccggccuggacugcaugcggcccugcuucuggguggagcucauccgcgggcggcccaaggagaagaccaucuggacgagcggcuccagcaucuccuucugcggcgugaacagcgacaccgucgacugguccuggcccgacggggccgagcugccguucaccaucgacaaguga

SEQ ID NO: 84502 - RNA, 1368 nt, Artificial Sequence
  derived and/or modified sequence opt1 from neuraminidase__InfluenzaA__AGQ47814
augaaccccaaccagaagaucaucaccaucggcagcaucugcauggccaucgggaucaucucccugauccuccagaucggcaacaucaucagcaucugggugucccacagcauccagaccgggucccagaaccacacgggcaucugcaaccagcgcaucaucaccuacgagaacaacaccugggucaaggacaccacgagcaugacccuggccgggaacuccagccugugcccgauccggggcugggcgaucuacuccaaggacaacagcauccgcaucggcuccaagggggacguguucgugauccgggagcccuucaucagcugcucccaccucgagugccgcaccuucuuccugacccagggcgcccugcucaacgacaagcacagcaacgggacggucaaggaccggucccccuaccgcgcccugaugagcugccccaucggcgaggccccgucccccuacaacagccgguucgaguccguggccuggagcgcgagcgccugccacgacgggaugggcuggcugaccaucggcaucuccgggcccgacgacggcgccguggccguccucaaguacaacgggaucaucaccgagaccaucaagagcuggaagaagcagauccugcgcacgcaggaguccgagugcgugugcgugaacggcagcugcuucaccaucaugaccgacggccccuccgacgggccggcgagcuaccggaucuucaagaucgagaagggcaagaucaccaaguccaucgagcuggacgcccccaacagccacuacgaggagugcuccugcuaccccgacacggggaccgucaugugcgugugccgcgacaacuggcacggcagcaaccggcccuggguguccuucaaccagaaccucgacuaccagaucggguacaucugcagcggcgucuucggcgacaacccgcgccccaaggacgggaagggcuccugcgaccccgugaacguggacggggccgacggcgucaagggguucagcuaccgguacggcaacggcguguggaucgggcgcaccaaguccaacagcucccggaagggcuucgagaugaucugggaccccaacggguggaccgacacggacggcaacuuccuggugaagcaggacgucguggccaugaccgacuggagcggguacuccggcagcuucgugcagcacccggagcugaccggccucgacugcaugcgccccugcuucugggucgagcugauccgggggcgcccccgggagaagaccacgaucuggaccagcggcuccagcaucuccuucugcggggugaacagcgacaccgugaacugguccuggcccgacggcgccgagcugccguucaccaucgacaaguga

SEQ ID NO: 84503 - RNA, 1413 nt, Artificial Sequence; identical to SEQ ID NO: 77465
  derived and/or modified sequence opt1 from neuraminidase__InfluenzaA__AGQ47826

SEQ ID NO: 84504 - RNA, 1410 nt, Artificial Sequence
  derived and/or modified sequence opt1 from neuraminidase__InfluenzaA__AGQ47838
augaaccccaaccagaagaucaucaccaucggcagcgugucccugaccaucgccacgaucugcuuccucaugcagaucgccauccuggucaccaccgugacccugcacuucaagcaguacgagugcgacagcccggcgaacaaccaggugaugcccugcgagcccaucaucaucgagcgcaacaucacggagaucgucuaccucaccaacaccaccaucgagaaggagaucugccccaagcuggugggguaccggaacugguccaagccgcagugcaagaucacgggcuucgcccccuucagcaaggacaacuccauccgccugagcgccgggggcgacaucugggugacccgggagcccuacgucuccugcgaccccgggaagugcuaccaguucgcccucggccagggcaccacccuggacaacaagcacagcaacgacacgauccacgaccgcaccccgcaccggacccugcucaugaacgagcugggggugcccuuccaccugggcaccaagcaggucugcaucgccugguccagcuccagcugccacgacgggaaggcguggcuccacgugugcgugacgggcuacgacaagaacgccaccgccuccuucaucuacgacgggcgccugguggacagcaucggcuccuggagccagaacauccugcggacccaggaguccgagugcgucugcaucaacgggaccugcacgguggugaugaccgacggcagcgccuccggccgcgcggacaccaagauccucuucaucgaggaggggaagaucguccacaucagcccccugagcggcuccgcccagcacguggaggagugcagcugcuacccccgguacccgggcgugcgcugcaucugccgggacaacuggaagggguccaaccgccccgucguggacaucaacgugaaggacuacagcaucgacuccagcuacgucugcuccggccuggugggggacacgccccggaacaacgaccgcagcuccagcuccuacugccggaaccccaacaacgagaagggcaaccacggggugaagggcugggccuucgacgacggcaacgacgucuggauggggcgcaccaucagcgaggacucccggagcggcuacgagaccuucaaggugaucgggggcugguccaccccgaacagcaagcuccagaucaaccgccaggucaucguggacuccgacaaccggagcggguacuccggcaucuucagcguggagggcaagagcugcaucaaccgcugcuucuacgucgagcugauccgggggcgcgagcaggagacccgcgugugguggacguccaacagcaucguggucuucugcggcaccuccgggaccuacggcaccgggagcuggcccgacggcgccgacaucaaccugaugcccaucuga

SEQ ID NO: 84505 - RNA, 1362 nt, Artificial Sequence
  derived and/or modified sequence opt1 from neuraminidase__InfluenzaA__AGQ47850
augaaccccaaccagaagaucaucaccaucggcagcaucugcaugguggucgggaucaucucccugauccuccagaucggcaacaucaucagcaucuggaucucccacagcauccaggccggguccagcaccugggugaaccagacguacgugaacaucuccaacaccaacgucguggccggcccggacgcgaccagcgugauccugaccgggaacuccagccugugccccauccgcggcugggccaucuacuccaaggacaacggcauccggaucgggagcaagggcgacaucuucgucauccgcgagcccuucaucuccugcagccaccucgagugccgggccuucuuccugacgcagggggcccugcucaacgacaagcacuccaacggcaccgugaaggaccgcagccccuaccgggcccugauguccugcccggugggggaggcgcccagccccuacaacucccgcuucgagagcgucgccuggagcgccuccgccugccacgacggcaugggcuggcugaccaucgggaucagcggccccgacaacggggcgguggccgugcucaaguacaacggcaucaucaccgagacgaucaaguccuggcggaagaagauccugcgcacccaggagagcgagugcgccugcgucaacggcuccugcuucaccaucaugaccgacgggccgagcgacggccccgccuccuacaagaucuucaagaucgagaaggggaaggugaccaagagcaucgagcuggacgcccccaacucccacuacgaggagugcagcugcuaccccgacacgggcaaggugaugugcgucugccgggacaacuggcacggguccaaccgcccgugggugagcuucgaccagaaccucgacuaccagaucggcuacaucugcuccggcguguucggggacagcccccggcccaaggacggcaccggguccugcggccccgucagcguggacggggcgaacggcgugaagggcuucuccuaccgcuacgggaacggcgucuggaucgggcggaccaagagcaaguccagccgccacggcuucgagaugaucugggacccgaacggguggacggagaccgacagccgguucuccgugcgccaggacguggucgccaugaccgacuggagcggcuacuccggcagcuucgugcagcaccccgagcugaccgggcuggacugcaugcggcccugcuucugggucgagcucauccgcggccagcccaaggagaagacgaucuggaccuccgggagcuccaucagcuucugcggcgugaacuccgacaccguggacuggagcuggccggacggcgccgagcugcccuucaccaucgacaaguga

SEQ ID NO: 84506 - RNA, 1410 nt, Artificial Sequence
  derived and/or modified sequence opt1 from neuraminidase__InfluenzaA__AGQ47873
augaacaccaaccagcgcaccaucacgaucggcaccaucugccugaucguggggaucaucagccuccugcugcagaucggcaacaucauccuccuguggaugucccacagcauccagaccggggagaagucccaccccaaggucugcaaccagagcgugaucaccuacgagaacaacacgugggugaaccagaccuacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggacguucuuccugacccagggggcccuccugaacgaccgccacagcaacggcaccgucaaggaccggucccccuaccgcacccugaugagcugcccgaucggggaggcccccucccccuacaacagccgguucgaguccguggccuggagcgcgagcgccugccacgacggcaugggcuggcucacgaucgggaucuccggccccgacaacggggccguggccguccugaaguacaacggcaucaucaccgacaccaucaagagcuggcgcaacaagauccugcggacccaggaguccgagugcgugugcaucaacggcagcugcuucacgaucaugaccgacgggccguccaacggccaggcgagcuacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugagcuucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggagcggguucgagaugaucugggaccccaacggcuggacggagaccgacuccagcuucagcaugaagcaggacaucaucgcccugaccgacugguccggguacagcggcuccuucgugcagcaccccgagcugaccggcaugaacugcauccgcccgugcuucuggguggagcucauccgggggcagcccaaggagagcacgaucuggaccuccggcagcuccaucagcuucugcggggucaacuccggcaccgcgagcugguccuggcccgacggcgccgaccugcccuucaccaucgacaaguga

SEQ ID NO: 84507 - RNA, 1410 nt, Artificial Sequence; identical to SEQ ID NO: 78222
  derived and/or modified sequence opt1 from neuraminidase__InfluenzaA__AGQ47885

SEQ ID NO: 84508 - RNA, 1410 nt, Artificial Sequence; identical to SEQ ID NO: 82988
  derived and/or modified sequence opt1 from neuraminidase__InfluenzaA__AGQ47897

SEQ ID NO: 84509 - RNA, 1410 nt, Artificial Sequence; identical to SEQ ID NO: 75103
  derived and/or modified sequence opt1 from neuraminidase__InfluenzaA__AGQ47909

SEQ ID NO: 84510 - RNA, 1410 nt, Artificial Sequence
  derived and/or modified sequence opt1 from neuraminidase__InfluenzaA__AGQ47921
augaaccccaaccagaagaucaucaccaucggcagcgugucccugaccaucgccacggucugcuuccucaugcagaccgccauccuggugaccaccgugacgcugcacuucaagcaguacgagugcgacagcccggcguccaaccaggucaugcccugcgagcccaucaucaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacagcauccgccuguccgccggcggggacaucugggugacccgggagcccuacgugagcugcgaccacggcaagugcuaccaguucgcccuggggcagggcaccacccucgacaacaagcacuccaacgacacgauccacgaccgcaucccccaccggacccugcugaugaacgagcucggcgucccguuccaccuggggacccgccaggugugcaucgccuggagcuccagcuccugccacgacggcaaggcguggcugcacgugugcaucaccggggacgacaagaacgccacggccagcuucaucuacgacggccggcucgucgacuccaucgggagcuggucccagaacauccugcgcacccaggagagcgagugcgugugcaucaacgggaccugcaccguggucaugacggacggcuccgccagcggccgggcggacacccgcauccuguucaucgaggagggcaagaucgugcacaucagcccccucuccgggagcgcccagcacguggaggagugcuccugcuacccccgguaccccggcguccgcugcaucugccgggacaacuggaagggcagcaaccgcccggugguggacaucaacauggaggacuacuccaucgacagcuccuacgucugcagcgggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggagcacccccaacuccaagagccagaucaaccggcaggucaucguggacuccgacaaccgcagcggcuacuccgggaucuucagcguggagggcaagagcugcaucaaccgcugcuucuacgucgagcucauccggggccgcaagcaggaggcccgggugugguggaccuccaacagcaucguggucuucugcgggaccuccggcacguacgggaccggcagcuggccggacggggccaacaucaacuucaugcccaucuga

SEQ ID NO: 84511 - RNA, 1365 nt, Artificial Sequence
  derived and/or modified sequence opt1 from neuraminidase__InfluenzaA__AGQ47933
augaaccccaaccagaagaucaucaccaucggcagcaucugcaugguggucgggcugaucucccucauccugcagaucggcaacaucaucagcaucuggaucucccacagcauccagaccgggucccagaaccacacgggcaucugcaaccagaacaucaucaccuacaagaacagcaccugggugaaggacaccacguccgugauccugaccgggaacagcucccucugcccgauccgcggcugggccaucuacagcaaggacaacuccauccggaucggcagcaagggggacgucuucgugauccgcgagcccuucaucuccugcagccaccuggagugccggaccuucuuccugacccagggcgcccuccugaacgaccgccacuccaacgggacggugaaggaccggagccccuaccgcgcgcugauguccugccccgucggcgaggccccgagccccuacaacucccgguucgagagcguggccuggagcgccuccgccugccacgacgggaugggcuggcucaccaucggcaucagcgggcccgacaacggcgcgguggccguccugaaguacaacgggaucaucaccgagaccaucaaguccuggcgcaagaagauccugcggacgcaggagagcgagugcgccugcgugaacggcuccugcuucaccaucaugaccgacggccccagcgacgggcucgccuccuacaagaucuucaagaucgagaagggcaaggugaccaagagcaucgagcugaacgcgccgaacucccacuacgaggagugcagcugcuaccccgacacggggaaggucaugugcgugugccgcgacaacuggcacggcuccaaccggcccugggugagcuucgaccagaaccuggacuaccagaucggguacaucugcuccggcgucuucggcgacaacccccgcccgaaggacgggaccggcagcugcgggcccguguacguggacggcgccaacggggucaagggcuucuccuaccgguacggcaacgggguguggaucggccgcaccaagagccacuccagccggcacggguucgagaugaucugggaccccaacggcuggaccgagacggacuccaaguucagcgugcgccaggacgucguggccaugaccgacuggagcggguacuccggcagcuucgugcagcaccccgagcucaccggccuggacugcauccggccgugcuucugggucgagcugauccgcgggcggcccaaggagaagaccaucuggacguccgccagcuccaucagcuucugcggcgugaacuccgacaccgucaacuggagcuggcccgacggggccgagcuccccuucaccaucgacaaguga

SEQ ID NO: 84512 - RNA, 1365 nt, Artificial Sequence; identical to SEQ ID NO: 76727
  derived and/or modified sequence opt1 from neuraminidase__InfluenzaA__AGQ47945

SEQ ID NO: 84513 - RNA, 1365 nt, Artificial Sequence; identical to SEQ ID NO: 76727
  derived and/or modified sequence opt1 from neuraminidase__InfluenzaA__AGQ47957

SEQ ID NO: 84514 - RNA, 1365 nt, Artificial Sequence; identical to SEQ ID NO: 76727
  derived and/or modified sequence opt1 from neuraminidase__InfluenzaA__AGQ47969

SEQ ID NO: 84515 - RNA, 1365 nt, Artificial Sequence; identical to SEQ ID NO: 76727
  derived and/or modified sequence opt1 from neuraminidase__InfluenzaA__AGQ47981

SEQ ID NO: 84516 - RNA, 1365 nt, Artificial Sequence
  derived and/or modified sequence opt1 from neuraminidase__InfluenzaA__AGQ48005
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugccgggacaacuggcacggcagcaaccgccccuggguguccuucgaccagaaccucgacuaccagaucggguacaucugcagcggcgucuucggcgacaacccccggccggaggacgggaccggcuccugcgggcccguguacguggacggcgccaacggggucaagggcuucagcuaccgcuacuccaacggcguguggaucgggcggaccaagagccacuccagccgccacggcuucgagaugaucugggaccccaacggguggaccgagacggacagcaaguucuccgugcggcaggacgucguggccaugaccgacuggagcggcuacuccgggagcuucgugcagcaccccgagcugaccggccuggacugcaugcgcccgugcuucugggucgagcucauccggggccgccccaaggagaagaccaucuggacguccgccagcuccaucagcuucugcggggugaacuccgacaccgucgacuggagcuggcccgacggcgccgagcugcccuucuccaucgacaaguga

SEQ ID NO: 84517 - RNA, 1365 nt, Artificial Sequence; identical to SEQ ID NO: 84516
  derived and/or modified sequence opt1 from neuraminidase__InfluenzaA__AGQ48017

SEQ ID NO: 84518 - RNA, 1365 nt, Artificial Sequence; identical to SEQ ID NO: 76727
  derived and/or modified sequence opt1 from neuraminidase__InfluenzaA__AGQ48029

SEQ ID NO: 84519 - RNA, 1365 nt, Artificial Sequence
  derived and/or modified sequence opt1 from neuraminidase__InfluenzaA__AGQ48041
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccuggaucaaggacaccacguccgugauccucaccgggaacagcucccugugcccgauccgcggcugggccaucuacagcaaggacaacuccauccggaucggcagcaagggggacguguucgucauccgcgagcccuucaucuccugcagccaccuggagugccggaccuucuuccucacccagggcgcccugcugaacgacaagcacuccagcgggacggugaaggaccgcucccccuaccgggcgcucaugagcugccccgugggcgaggccccgucccccuacaacagccgcuucgagagcgucgccugguccgccagcgccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggugaugugcgucugccgggacaacuggcacggcagcaaccgccccuggguguccuucgaccagaaccucgacuaccagaucggguacaucugcagcggcguguucggcgacaacccccggccggaggacgggaccggcuccugcgggcccgucuacguggacggcgccaacggggugaagggcuucagcuaccgcuacggcaacggggucuggaucggccggaccaagucccacagcucccgccacggguucgagaugaucugggaccccaacggcuggaccgagacggacagcaaguucagcgugcggcaggacguggucgccaugaccgacugguccggguacagcggcuccuucgugcagcaccccgagcugaccggccuggacugcaugcgcccgugcuucuggguggagcucauccgggggcgccccaaggagaagaccaucuggacgagcgccuccagcaucuccuucugcggcgucaacagcgacaccguggacugguccuggcccgacggggccgagcugcccuucagcaucgacaaguga

SEQ ID NO: 84520 - RNA, 1365 nt, Artificial Sequence
  derived and/or modified sequence opt1 from neuraminidase__InfluenzaA__AGQ48053
augaaccccaaccagaagaucaucaccaucggcagcaucugccugguggucgggcucaucucccugauccugcagaucggcaacaucaucagcaucuggaucucccacagcauccagaccgggucccagaaccacacgggcaucugcaaccagaacaucaucaccuacaagaacagcaccuggaucaaggacaccacguccgugauccucaccgggaacagcucccugugcccgauccgcggcugggccaucuacagcaaggacaacuccauccggaucggcagcaagggggacguguucgucauccgcgagcccuucaucuccugcagccaccuggagugccggaccuucuuccucacccagggcgcccugcugaacgacaagcacuccagcgggacggugaaggaccgcucccccuaccgggcgcucaugagcugccccgugggcgaggccccgucccccuacaacagccgcuucgagagcgucgccugguccgccagcgccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaacggcagcugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggugaugugcgucugccgggacaacuggcacggcagcaaccgccccuggguguccuucgaccagaaccucgacuaccagaucggguacaucugcagcggcguguucggcgacaacccccggccggaggacgggaccggcuccugcgggcccgucuacguggacggcgccaacggggugaagggcuucagcuaccgcuacggcaacggggucuggaucggccggaccaagucccacagcucccgccacggguucgagaugaucugggaccccaacggcuggaccgagacggacagcaaguucagcgugcggcaggacguggucgccauggccgacugguccggguacagcggcuccuucgugcagcaccccgagcugaccggccuggacugcaugcgcccgugcuucuggguggagcucauccgggggcgccccaaggagaagaccaucuggaccagcgccuccagcaucuccuucugcggcgucaacagcgacacgguggacugguccuggcccgacggggcggagcugcccuucagcaucgacaaguga

SEQ ID NO: 84521 - RNA, 1410 nt, Artificial Sequence
  derived and/or modified sequence opt1 from neuraminidase__InfluenzaA__AGQ81707
augaaccccaaccagaagaucaucaccaucggcagcaucugcauggugaucgggaucgccucccugaugcuccagaucggcaacaugaucagcaucugggucucccacagcauccagaccgggaaccaguaccagccggagcccugcaaccaguccaucaucacguacgagaacaacaccugggugaaccagaccuacgugaacaucagcaacaccaacuuccugacggagcaggccgucaccuccguggcgcuggccggcaacagcucccucugccccaucagcgggugggccaucuacuccaaggacaacggcauccgcaucggcagcaagggggacguguucgucauccgggagcccuucaucuccugcagccaccuggagugccgcaccuucuuccugacccagggcgcccuccugaacgacaagcacuccaacgggacggugaaggaccggagcccguaccgcacccugauguccugccccgugggcgaggcccccagccccuacaacucccgguucgagagcgucgcguggagcgccuccgccugccacgacgggaucagcuggcucaccaucggcaucuccggcccggacaacggggccguggcggugcugaaguacaacggcaucaucaccgacacgaucaagagcuggcgcaacaacauccugcggacccaggaguccgagugcgccugcgucaacgggagcugcuucaccgugaugaccgacggccccuccaacggccaggccagcuacaagaucuucaagaucgagaaggggaagguggucaaguccguggagcucaacgcccccaacuaccacuacgaggagugcagcugcuaccccgacgccggcaagaucaugugcgugugccgcgacaacuggcacggguccaaccggccgugggucagcuucaaccagaaccuggaguaccagaucggcuacaucugcuccgggguguucggcgacaacccccgccccaacgacggcacggggagcugcggccccguguccagcaacggggcguacggcgucaagggguucuccuucaaguacggcaacggcguguggaucgggcggaccaagagcaccuccagccgcagcggcuucgagaugaucugggacccgaacggguggaccgagacggacuccagcuucuccgugaagcaggacaucgucgccaucaccgacuggagcggcuacuccgggagcuucgugcagcaccccgagcugaccggccucgacugcaugcggcccugcuucugggucgagcugauccgcggccggcccaaggagaacaccaucuggacguccgggagcuccaucagcuucugcggcguggacuccgacaccgugggguggagcuggccggacggcgccgagcugcccuucaccaucgacaaguga

SEQ ID NO: 84522 - RNA, 1410 nt, Artificial Sequence
  derived and/or modified sequence opt1 from neuraminidase__InfluenzaA__AGQ81715
augaaccccaaccagaagaucaucgccaucggcagcgugucccugaccaucgccaccaucugccuccugaugcagaucgcgauccuggucacgaccaugacccuccacuucaagcacaacgagugcaccaacagcuccaacaaccaggccgugccgugcgggcccaucaucaucgagcgcaacgugacggagaucguccaccugaacagcaccacccuggagaaggagaucugccccaaggccgccggcuaccgggacugguccaagccccagugccagaucaccggguucgccccguucagcaaggacaacuccauccgccucagcgcguccggcgacaucugggugacgcgggagcccuacgugagcugcgggcugggcaagugcuaccaguucgcccugggccaggggaccacccucgacaaccgccacuccaacggcaccagccacgaccggacgcccuaccgcacccugcugaugaacgagcucgggguccccuuccaccuggccaccaagcaggucugcaucgccugguccagcuccagcugccacgacggcaaggcguggcugcacgugugcgugaccggggacgaccggaacgccacggccuccaucaucuacgacggcauccucguggacagcaucggcuccuggagcaagaacauccugcgcacccaggagagcgagugcgugugcaucaacgggaccugcaccgucgugaugacggacggcuccgccagcgggaaggccgacacccggauccuguucauccgcgagggcaagaucgugcacaucuccccgcucagcggcuccgcgcagcacgucgaggagugcagcugcuacccccaguaccccgaggugcggugcgugugccgcgacaacuggcggggguccaaccgccccguccuguacaucaacauggccgacuacagcaucgacuccggcuacgugugcagcgggcuggugggcgacaccccgcggaacgacgacaucuccagcuccagcaacugcaaggaccccaacaacgagcgcggggcccccggcgucaagggcugggccuucgacuccgggaacgacaucuggaugggccggaccaucgagaaggacagccgcuccggguacgagacguuccgggugaucggcggguggaacaccgccaacagcaagucccagaccagccgccaggugaucgucgacagcggcaacuccagcggcuacuccgggaucuucagcaucgagggcaaguccugcaucaaccggugcuucuacguggagcucauccgcgggcgccccaaggagacccgggucugguggacgagcaacuccaucaucguguucugcggcaccagcgggaccuacggcaccggcuccuggccggacggggcgaacaucaacuucauggccaucuga

SEQ ID NO: 84523 - RNA, 1410 nt, Artificial Sequence
  derived and/or modified sequence opt1 from neuraminidase__InfluenzaA__AGQ81717
augaaccccaaccagaagaucaucgccaucggcagcgugucccugaccaucgccaccaucugccuccugaugcagaucgcgauccuggucacgaccaugaccccgcacuucaagcacgacgagugcaccaacagcuccaacaaccaggccgugcccugcgggcccaucaucaucgagcgcaacgugacggagaucguccacaucaacagcaccauccucgagaaggagaucugccccaaggccgccggcuaccggaacugguccaagccgcagugccagaucaucggguucgcccccuucagcaaggacaacuccauccgccugagcgcguccggcgacaucugggugacccgggagcccuacgugagcugcgggcugggcaagugcuaccaguucgcccucggccaggggaccacgcuggacaaccgccacuccaacggcaccagccacgaccggacgccccaccgcacccugcucaugaacgagcugggggucccguuccaccuggccaccaagcaggucugcaucgccugguccagcuccagcugccacgacggcaaggcguggcuccacgugugcgugaccggggacgaccggaacgccaccgccuccaucaucuacgacggcaugcugguggacagcaucggcuccuggagcaagaacauccugcgcacccaggagagcgagugcgugugcaucaacgggacgugcaccgucgugaugaccgacggcuccgccagcgggaaggccgacacccggauccucuucauccgcgagggcaagaucgugcacaucagcccccuguccggcuccgcgcagcacgucgaggagugcagcugcuacccccaguaccccgaggugcggugcgugugccgcgacaacuggcggggguccaaccgcccgguccuguacaucaacauggccgacuacagcaucgacuccggcuacgugugcagcgggcucgugggcgacacgccccggaacgacgacaucuccagcuccagcaacugcaaggaccccaacaacgagcgcggggcccccggcgucaagggcugggccuucgacuccgggaacgacaucuggaugggccggaccaucgagaaggacagccgcuccggguacgagaccuuccgggugaucggcggguggaacaccgccaacagcaagucccagacgagccgccaggugaucgucgacagcgacaacuccagcggcuacuccggcaucuucagcguggaggggaaguccugcaucaaccggugcuucuacgucgagcugauccgcggccgcccgaaggagacccgggugugguggaccagcaacuccaucaucguguucugcgggaccagcggcacguacgggaccggcuccuggcccgacggcgcgaacaucaacuucauggccaucuga

SEQ ID NO: 84524 - RNA, 1410 nt, Artificial Sequence
  derived and/or modified sequence opt1 from neuraminidase__InfluenzaA__AGQ81718
augaaccccaaccagaagaucaucgccaucggcagcgugucccugaccaucgccaccaucugccuccugaugcagaucgcgauccuggucacgaccaugacccuccacuucaagcacaacgagugcaccaacagcuccaacaaccaggccgugccgugcgggcccaucaucaucgagcgcaaccugacggagaucgugcaccugaacagcaccauccucgagaaggagaucugccccaaggccgccggcuaccggaacugguccaagccccagugccagaucaccggguucgccccguucagcaaggacaacuccauccgccugagcgcguccggcgacaucugggucacccgggagcccuacgugagcugcgggcugggcaagugcuaccaguucgcccucggccaggggacgacccuggacaaccgccacuccaacggcaccagccacgaccggacgccccaccgcacccugcucaugaacgagcugggggugcccuuccaccuguccaccaagcaggucugcaucgccuggagcuccagcuccugccacgacggcaaggccuggcuccacgugugcgugaccggggacgaccggaacgcgaccgccagcaucaucuacgacggcauccuggucgacuccaucgugagcuggagcaagaacauccugcgcacgcaggaguccgagugcgugugcaucaacgggaccugcaccgucgugaugaccgacggcagcgccuccggcaaggccgacacgcggauccucuucauccgcgaggggaagaucgugcacaucagcccgcuguccggcagcgcccagcacgucgaggagugcuccugcuacccccgguaccccgaggugcgcugcgugugccgggacaacuggcgcggcagcaaccggcccguccuguacaucaacauggcggacuacuccaucgacagcggguacgugugcuccggccucgugggggacaccccgcgcaacgacgacaccagcuccagcuccaacugccgggaccccaacaacgagcgcggcgcccccggggucaagggcugggccuucgacagcggcaacgacaucuggauggggcggaccaucgagaaggacucccgcagcggcuacgagacguuccgggugaucgggggcuggaacaccgccaacuccaagagccagaccagccgccaggugaucgucgacuccgacaacagcuccggguacagcggcguguucuccgucgagggcaagagcugcaucaaccgcugcuucuacguggagcugauccgggggcgccccaaggagacccgggugugguggacguccaacagcaucaucgucuucugcggcaccuccgggaccuacggcaccgggagcuggccggacggcgccaacaucaacuucauggcgaucuga

SEQ ID NO: 84525 - RNA, 1410 nt, Artificial Sequence
  derived and/or modified sequence opt1 from neuraminidase__InfluenzaA__AGQ81719
augaaccccaaccagaagaucaucgccaucggcagcgugucccugaccaucgccaccaucugccuccugaugcagaucgcgauccuggucacgaccaugacccuccacuucaagcacaacgagugcaccaacagcuccaacaaccaggccgugccgugcgggcccaucaucaucgagcgcaacgugacggagaucguccaccugaacagcaccacccuggagaaggagaucugcaccaaggccgccggcuaccgggacugguccaagccccagugccagaucacgggguucgcccccuucagcaaggacaacuccauccgccucagcgcguccggcgacaucugggugacccgggagccguacgugagcugcgggcugggcaagugcuaccaguucgcccugggccaggggaccacccucgacaaccgccacuccaacggcacgacccacgaccggacgccccaccgcacccugcugaugaacgagcucgggguccccuuccaccuggccaccaagcaggucugcaucgccuggagcuccagcuccugccacgacggcaaggcguggcugcacgugugcgugaccggggacgaccggaacgccaccgccagcaucaucuacgacggcauccucguggacuccaucggcagcugguccaagaacauccugcgcacccaggagagcgagugcgugugcaucaacgggacgugcaccgucgugaugaccgacggcagcgccuccgggaaggccgacacccggauccuguucauccgcgagggcaagaucgugcacaucagcccccucuccggcagcgcgcagcacgucgaggagugcuccugcuacccgcaguaccccgaggugcggugcgugugccgcgacaacuggcgggggagcaaccgccccguccuguacaucaacauggccgacuacuccaucgacagcggcuacgugugcuccgggcuggugggcgacacgccccggaacgacgacaucagcuccaacagcaacugcaaggacccgaacaacgaguccggggcccccggcgucaagggcugggccuucgacagcgggaacgacaucuggaugggccgcaccaucgagaaggacucccggagcggguacgagaccuuccgcgugaucggcggguggaacaccgccaacuccaagagccagacgucccgccaggugaucgucgacagcgacaacagcuccggcuacagcggcaucuucuccaucgagggcaagagcugcaucaaccggugcuucuacguggagcucauccgggggcgccccaaggagacccgcgucugguggaccuccaacagcaucaucguguucugcgggaccuccggcacguacgggaccggcagcuggcccgacggcgcgaacaucaacuucauggccaucuga

SEQ ID NO: 84526 - RNA, 1410 nt, Artificial Sequence
  derived and/or modified sequence opt1 from neuraminidase__InfluenzaA__AGQ81722
augaaccccaaccagaagaucaucgccaucggcagcgugucccugaccaucgccaccaucugccuccugaugcagaucgcgauccuggucacgaccaugaccccgcacuucaagcacgacgagugcaccaacagcuccaacaaccaggccgugcccugcgggcccaucaucaucgagcgcaacgugacggagaucguccacaucaacagcaccauccucgagaagggcaucugccccaaggccgccggguaccggaacugguccaagccgcagugccagaucaucggcuucgcccccuucagcaaggacaacuccauccgccugagcgcguccggggacaucugggugacccgggagcccuacgugagcugcggccugggcaagugcuaccaguucgcccucgggcagggcaccacgcuggacaaccgccacuccaacgggaccagccacgaccggacgccccaccgcacccugcucaugaacgagcugggcgucccguuccaccuggccaccaagcaggucugcaucgccugguccagcuccagcugccacgacgggaaggcguggcuccacgugugcgugaccggcgacgaccggaacgccaccgccuccaucaucuacgacggcaugcugguggacagcaucggguccuggagcaagaacauccugcgcacccaggagagcgagugcgugugcaucaacggcacgugcaccgucgugaugaccgacggguccgccagcggcaaggccgacacccggauccucuucauccgcgagggcaagaucgugcacaucagcccccuguccggguccgcgcagcacgucgaggagugcagcugcuacccccaguaccccgaggugcggugcgugugccgcgacaacuggcggggcuccaaccgcccgguccuguacaucaacauggccgacuacagcaucgacuccggguacgugugcagcggccucgugggggacacgccccggaacgacgacaccuccagcuccagcaacugcaaggaccccaacaacgagcgcggcgcccccggcgucaaggggugggccuucgacuccggcaacgacaucuggauggggcggaccaucgagaaggacagccgcuccggcuacgagaccuuccgggugaucgggggcuggaacacggccaacagcaagucccagaccagccgccaggugaucgucgacagcgacaacuccagcggcuacuccgggaucuucagcguggagggcaaguccugcaucaaccggugcuucuacgucgagcugauccgcgggcgcccgaaggagacccgggugugguggaccagcaacuccaucaucguguucugcggcacgagcgggaccuacggcaccggcuccuggcccgacggggcgaacaucaacuucauggccaucuga

SEQ ID NO: 84527 - RNA, 1410 nt, Artificial Sequence
  derived and/or modified sequence opt1 from neuraminidase__InfluenzaA__AGQ81724
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacaaccaggccgugccgugcgggcccaucaucaucgagcgcaacgugaccgagaucguccaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucugcaucgccuggagcuccagcuccugccacgacggcaaggcguggcugcacgugugcgugaccggggacgaccggaacgccaccgccagcaucaucuacgacggcauccucguggacuccaucggcagcuggagcaagaacauccugcgcacgcaggaguccgagugcgugugcaucaacgggaccugcaccgucgugaugaccgacggcagcgccuccgggaaggccgacacgcggauccuguucauccgcgagggcaagaucgugcacaucagcccgcucuccggcagcgcgcagcacgucgaggagugcuccugcuacccccaguaccccgaggugcggugcgugugccgcgacaacuggcgggggagcaaccgccccguccuguacaucaacauggaggacuacuccaucgacagcggcuacgugugcuccgggcuggugggcgacaccccgcggaacgacgacaucagcuccagcuccaacugcaaggaccccaacaacgagcgcggggcccccggcgucaagggcugggccuucgacagcgggaacgaccucuggaugggccggaccaucgagaaggacucccgcagcggguacgagaccuuccgggugaucggcggguggaacacggccaacuccaagagccagaccagccgccaggugaucgucgacuccgacaacagcuccggcuacagcggcaucuucuccguggagggcaagagcugcaucaaccggugcuucuacgucgagcugauccgcgggcgccccaaggagacccgggugugguggaccuccaacagcaucaucguguucugcgggacguccggcaccuacgggaccggcagcuggccggacggcgccaacaucaacuucauggcgaucuga

SEQ ID NO: 84528 - RNA, 1410 nt, Artificial Sequence
  derived and/or modified sequence opt1 from neuraminidase__InfluenzaA__AGQ81726
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacaaccaggccgugccgugcgggcccaucaucaucgagcgcaacaucaccgagaucgugcaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggagcuccagcuccugccacgacggcaaggcguggcugcacgugugcgugaccggggacgaccggaacgccaccgccagcaucaucuacgacggcauccucgucgacuccaucggcagcuggagcaagaacauccugcgcacgcaggaguccgagugcgugugcaucaagcggaccugcaccguggucaugaccgacgggagcgccuccggcaaggccgacacgcgcauccuguucauccgggaggggaagaucgugcacaucagcccgcucuccggcagcgcgcagcacguggaggagugcuccugcuacccccaguaccccgagguccgcugcgugugccgggacaacuggcgcggcagcaaccggcccgugcuguacaucaacauggccgacuacuccaucgacagcggguacgucugcuccggccuggugggggacaccccgcgcaacgacgacaucagcuccagcuccaacugcaaggaccccaacaacgagcggggcgcccccggggugaagggcugggccuucgacagcggcaacgaccucuggauggggcgcaccaucgagaaggagucccggagcggcuacgagaccuuccgcgucaucgggggcuggaacacggccaacuccaagagccagaccagccgccaggugaucguggacuccgacaacagcuccggguacagcggcaucuucuccgucgagggcaagagcugcaucaaccggugcuucuacguggagcugauccgcgggcggcccaaggagacccgcgucugguggaccuccaacagcaucaucguguucugcggcacguccgggaccuacggcaccgggagcuggccggacggcgcgaacaucaacuucauggccaucuga

SEQ ID NO: 84529 - RNA, 1410 nt, Artificial Sequence
  derived and/or modified sequence opt1 from neuraminidase__InfluenzaA__AGQ81727
augaaccccaaccagaagaucaucgccaucggcagcgugucccugaccaucgccaccaucugccuccugaugcaggucgcgauccuggugacgaccaugacccuccacuucaagcacaacgagugcagcaacuccagcaacaaccaggccgugccgugcgggcccaucaucaucgagcgcaacaucaccgagaucguccaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucugcaucgccuggagcuccagcuccugccacgacggccgggcguggcugcacgugugcgugaccggggacgaccgcaacgccaccgccagcaucaucuacgacggcauccucguggacuccaucggcagcuggagcaagaacauccugcggacgcaggaguccgagugcgugugcaucaacgggaccugcaccgucgugaugaccgacggcagcgccuccgggaaggccgacacgcgcauccuguucauccgggagggcaagaucgugcacaucagcccgcucuccggcagcgcgcagcacgucgaggagugcuccugcuacccccaguaccccgaggugcgcugcgugugccgggacaacuggcgcgggagcaaccggcccguccuguacaucaacauggccgacuacuccaucgacagcggcuacgugugcuccgggcuggugggcgacaccccgcgcaacgacgacaucagcuccagcuccaacugcaaggaccccaacaacgagcgcggggcccccggcgucaagggcugggccuucgacagcgggaacgaccucuggaugggccggaccaucgagaaggagucccggagcggguacgagaccuuccgcgugaucggcggguggaacacggccaacuccaagagccagaccagccgccaggugaucgucgacuccgacaacagcuccggcuacagcggcaucuucuccguggagggcaagagcugcaucaaccggugcuucuacgucgagcugauccgcgggcggcccaaggagacccgcgugugguggaccuccaacagcaucaucguguucugcgggacguccggcaccuacgggaccggcagcuggccggacggcgcgaacaucaacuucaugcccaucuga

SEQ ID NO: 84530 - RNA, 1410 nt, Artificial Sequence
  derived and/or modified sequence opt1 from neuraminidase__InfluenzaA__AGQ81728
augaaccccaaccagaagaucguggccaucggcagcgucucccugaccaucgccaccaugugccuccugaugcagaucgcgcuguucgccacgaccaugacccuccacuucaagcagaccgggagcacgaacuccagcgacaaccaggccgugccgugcggccccaucaucaucgagcgcaacaucaccgagaucgugcaccugaacuccaccacccuggagaaggagacgugccccaagagcgccggguaccggaacugguccaagccccagugccagaucaccggcuucgccccguucagcaaggacaacuccauccgccucagcgcgggcggcgacaucugggucacccgggagcccuacguguccugcggccuggggaagugcuaccaguucgcccugggccaggggaccacgcucgacaacaagcacagcaacggcaccaccuacgaccgcacgccccaccggacccugcugaugaacgagcucggggugcccuuccaccuggccaccaagcaggucugcaucgccugguccagcuccagcugccacgacggcaaggcguggcugcacgugugcgugaccggcgacgacaagaacgccaccgccuccaucaucuacgacgggauccucgucgacagcaucgccuccuggagcaagaacauccugcgcacgcaggagagcgagugcgugugcaucaacgggaccugcaccguggucaugaccgacggguccgccagcggccgggcggacacgcgcauccuguucauccgggagggcaagaucgugcacaucuccccgcucagcggguccgcccagcacguggaggagugcagcugcuacccccgcuaccccgagguccggugcgugugccgcgacaacuggaagggcuccaaccggcccgugcuguacaucaacauggccgacuacagcaucgacuccagcuacgucugcuccgggaucgugggcgacaccccgcgcaacgacgaccggagcuccagcuccaacugccgcgaccccaacaacgagaucggggcccccggcgugaagggcugggccuucgacagcgggaacgacaucuggaugggccggaccaucgagaaggacucccgcagcggguacgagaccuuccgggucaucggcgggugguccacggcgaacagcaagagccagaucaaccgccaggugaucguggaccgggacaacuccagcggcuacuccggcaucuucagcgucgaggggaaguccugcaucaaccgcugcuucuacguggagcugauccgcggccggcccaaggagaaccgcgucugguggaccagcaacuccaucaucguguucugcgggaccagcggcaccuacgggacgggcuccuggccggacggcgccaacaucaaccucaugcccaucuga

SEQ ID NO: 84531 - RNA, 1410 nt, Artificial Sequence
  derived and/or modified sequence opt1 from neuraminidase__InfluenzaA__AGQ81729
augaaccccaaccagaagaucaucgccaucggcagcgugucccugaccaucgccaccaucugccuccugaugcagaucgcgauccuggucgccacgaugacccuccacagcaagcacggggagugcaccaacuccagcaacaaccaggccgugccgugcggccccaucaucaucgagcgcaacgugaccgagaucguccaccugaacuccacgacccuggagaaggagaucugccccaaggccgccggguaccgggacuggagcaagccccagugccagaucaccggcuucgcgccguucuccaaggacaacagcauccgccucuccgccagcggggacaucugggugacccgggagcccuacguguccugcggccugggcaagugcuaccaguucgcccuggggcagggcacgacccucgacaaccgccacagcaacgggaccucccacgaccggacgccccaccgcacccugcugaugaacgagcucggcauccccuuccaccuggccaccaagcaggucugcaucgcguggagcuccagcuccugccacgacgggaaggccuggcugcacgugugcgugaccggcgacgaccggaacgccaccgccagcaucaucuacgacggcaugcucgucgacuccaucgggagcuggagcaagaacauccugcgcacgcaggaguccgagugcgugugcaucaacgggaccugcaccguggucaugaccgacggcagcgccuccggcaaggcggacacgcggauccuguucauccgcgagggcaagaucgugcacaucagcccgcuccugggguccgcccagcacguggaggagugcagcugcuacccccaguaccccgagguccggugcgugugccgcgacaacuggcggggcuccaaccgccccgugcuguacaucaacauggccgacuacagcgucgacuccggguacgugugcagcggccucgugggggacaccccgcggaacgacgacaccuccagcuccagcaacugcaaggaccccaacaacgagcgcggcgcccccggcgucaaggggugggccuucgacuccggcaacgacaucuggauggggcggaccaucgagaaggacagccgcuccggcuacgagacguuccgggugaucgggggcuggaacaccgcgaacagcaagucccagaccagccgccaggugaucgucgacagcgacaacuccagcggcuacuccgggaucuucagcguggagggcaaguccugcaucaaccggugcuucuacgucgagcugauccgcgggcgccccaaggagacccgggugugguggacgagcaacuccaucaucguguucugcggcaccagcgggaccuacggcaccggcuccuggccggacggggccaacaucaacuucaugcccaucuga

SEQ ID NO: 84532 - RNA, 1410 nt, Artificial Sequence
  derived and/or modified sequence opt1 from neuraminidase__InfluenzaA__AGQ81730
augaaccccaaccagaagaucaucgccaucggcagcgugucccugaccaucgccaccaucugccuccugaugcagaucgcgauccuggucacgaccaugacccuccacuucaagcacaacgagugcaucaacagcuccaacaaccagagcgugccgugcgggcccaucaucaucgagcgcaacgugaccgagaucguccaccugaacuccacgacccuggagaaggagaucugccccaaggccgccggcuaccgggacuggagcaagccccagugccagaucaccggguucgccccguucuccaaggacaacagcauccgccucuccgccagcggcgacaucugggugacccgggagcccuacguguccugcgggcugggcaagugcuaccaguucgcgcugggccaggggacgacccucgacaaccgccacagcaacggcaccucccacgaccggacgccccaccgcacccugcugaugaacgagcucgggguccccuuccaccuggccagcaagcaggucugcaucgccugguccagcuccagcugccacgacggcaaggccuggcugcacgugugcgugaccggggacgaccggaacgcgaccgccuccaucaucuacgacggcaugcucguggacagcaucggcagcugguccaagaacauccugcgcacccaggagagcgagugcgugugcaucaacgggacgugcaccgucgugaugaccgacggcuccgccagcggggaggccgacacccggauccuguucauccgcgagggcaagaucgugcacaucuccccgcucagcggcuccgcccagcacgucgaggagugcagcugcuacccccaguaccccgaggugcggugcgugugccgcgacaacuggcggggguccaaccgccccguccuguacaucaacauggcggacuacagcaucgacuccggcuacgugugcagcgggcuggugggcgacacgccgcggaacgacgacaucuccagcuccagcaacugcaaggaccccaacaacgagcgcggggcccccggcgucaagggcugggccuucgacuccgggaacgacaucuggaugggccggaccaucgagaaggacagccgcuccggguacgagaccuuccgggugaucggcggguggaacaccgccaacagcaagagccagacgucccgccaggugaucgucgacagcgacaacuccagcggcuacuccggcaucuucagcguggaggggaaguccugcaucaaccggugcuucuacgucgagcucauccgcggccgccccaaggagacccgggugugguggaccagcaacuccaucaucguguucugcgggaccagcggcacguacgggaccggcuccuggccggacggcgccaacaucaacuucauggcgaucuga

SEQ ID NO: 84533 - RNA, 1410 nt, Artificial Sequence
  derived and/or modified sequence opt1 from neuraminidase__InfluenzaA__AGQ81731
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacaaccaggccgugccgugcgggcccaucaucaucgagcgcaacaucaccgagaucgugcaccugaacuccacgacccuggagaaggagaucugccccaagaccgccggcuaccgggacuggagcaagccccagugccagaucaccggguucgccccguucuccaaggacaacagcauccgccucuccgccagcggcgacaucugggucacgcgggagcccuacguguccugcggguucggcaagugcuaccaguucgcgcugggccaggggaccacccuggacaaccgccacagcaacggcaccucccacgaccggacgccccaccgcacccuccugaugaacgagcugggggugcccuuccaccucgccaccaagcaggucugcaucgccuggagcuccagcuccugccacgacggcaaggccuggcugcacgugugcgugaccggggacgaccggaacgcgacggccagcaucaucuacgacggcauccuggucgacuccaucggcagcuggagcaagaacauccuccgcacccaggaguccgagugcgugugcaucaacgggaccugcaccguggucaugacggacggcagcgccuccgggaaggccgacacccggauccuguucauccgcgagggcaagaucgugcacaucagcccgcuguccggcagcgcccagcacguggaggagugcuccugcuacccccaguaccccgagguccggugcgugugccgcgacaacuggcgggggagcaaccgccccgugcucuacaucaacaugaccgacuacuccaucgacagcggcuacgucugcuccgggcuggugggcgacaccccgcggaacgacgacaucagcuccagcuccaacugcaaggaccccaacaacgagcgcggggcgcccggcgugaagggcugggccuucgacagcgggaacgaccuguggaugggccggacgaucgagaaggagucccgcagcggguacgagaccuuccgggucaucggcggguggaacaccgccaacuccaagagccagaccagccgccaggugaucguggacuccgacaacagcuccggcuacagcggcaucuucuccgucgagggcaagagcugcaucaaccggugcuucuacguggagcucauccgcgggcgccccaaggagacgcgggucugguggaccuccaacagcaucaucguguucugcgggaccuccggcaccuacgggacgggcagcuggccggacggcgccaacaucaacuucauggccaucuga

SEQ ID NO: 84534 - RNA, 1410 nt, Artificial Sequence
  derived and/or modified sequence opt1 from neuraminidase__InfluenzaA__AGQ81732
augaaccccaaccagaagaucaucgccaucggcagcgugucccugaccaucgccaccaucugccuccugaugcaggucgcgauccuggugacgaccaugacccuccacuucaagcacaacgagugcagcaacuccagcaacaaccaggccgugccgugcgggcccaucaucaucgagcgcaacaucaccgagaucguccaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucugcaucgccuggagcuccagcuccugccacgacggcaaggcguggcugcacgugugcgugaccggggacgaccggaacgccaccgccagcaucaucuacgacggcauccucguggacuccaucggcagcuggagcaagaacauccugcgcacgcaggaguccgagugcgugugcaucaacgggaccugcaccgucgugaugaccgacggcagcgccuccgggaaggccgacacgcggauccuguucauccgcgagggcaagaucgugcacaucagcccgcucuccggcagcgcgcagcacgucgaggagugcuccugcuacccccaguaccccgaggugcggugcgugugccgcgacaacuggcgggggagcaaccgccccguccuguacaucaacauggccgacuacuccaucgacagcggcuacgugugcuccgggcuggugggcgacaccccgcggaacgacgacaucagcuccagcuccaacugcaaggaccccaacaacgagcgcggggcccccggcgucaagggcugggccuucgacagcgggaacgaccucuggaugggccggaccaucgagaaggagucccgcagcggguacgagaccuuccgggugaucggcggguggaacacggccaacuccaagagccagaccagccgccaggugaucgucgacuccgacaacagcuccggcuacagcggcaucuucuccguggagggcaagagcugcaucaaccggugcuucuacgucgagcugauccgcgggcgccccaaggagacccgggugugguggaccuccaacagcaucaucguguucugcgggacguccggcaccuacgggaccggcagcuggccggacggcgcgaacaucaacuucaugcccaucuga

SEQ ID NO: 84535 - RNA, 1410 nt, Artificial Sequence
  derived and/or modified sequence opt1 from neuraminidase__InfluenzaA__AGQ81733
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacucccaggccgugccgugcgggcccaucaucaucgagcgcaacgugaccgagaucguccaccugaacagcacgacccuggagaaggagaucugccccaaggccgccgaguaccgggacugguccaagccccagugccagaucaccggcuucgccccguucagcaaggacaacuccauccgccucagcgcguccggggacaucugggugacccgggagcccuacgugagcugcggccuggggaagugcuaccaguucgcccugggccagggcacgacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccaccgccuccaucaucuacgacgggauccucguggacagcaucggcagcugguccaagaacauccugcgcacgcaggagagcgagugcgugugcaucaacgggaccugcaccgucgugaugaccgacggcuccgccagcggcaaggccgacacgcggauccuguucauccgcgaggggaagaucgugcacaucuccccgcucagcggcuccgcgcagcacgucgaggagugcagcugcuacccccaguaccccgaggugcggugcgugugccgcgacaacuggcggggcuccaaccgccccguccuguacaucaacauggccgacuacagcaucgacuccggguacgugugcagcggccuggugggggacaccccgcggaacgacgacaucuccagcuccagcaacugcaaggaccccaacaacgagcgcggcgcccccggggucaagggcugggccuucgacuccggcaacgaccucuggauggggcggaccaucgagaaggacagccgcuccggcuacgagaccuuccgggugaucgggggcuggaacacggccaacagcaagagccagaccucccgccaggugaucgucgacagcgacaacuccagcggguacuccggcaucuucagcguggagggcaaguccugcaucaaccggugcuucuacgucgagcugauccgcgggcgccccaaggagacccgggugugguggaccagcaacuccaucaucguguucugcggcacgagcgggaccuacggcaccggguccuggccggacggcgcgaacaucaacuucaugcccaucuga

SEQ ID NO: 84536 - RNA, 1410 nt, Artificial Sequence
  derived and/or modified sequence opt1 from neuraminidase__InfluenzaA__AGQ81734
augaaccccaaccagaagaucaucgccaucggcagcgugucccugaccaucgccaccaucugccuccugaugcagaucgcgauccuggucacgaccaugacccuccacuucaagcacaacgaguacagcaacuccagcaacaaccaggccgugccgugcgggcccaucaucaucgagcgcaacaucaccgagaucgugcaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggagcuccagcuccugccacgacggcaaggcguggcugcacgugugcgugaccggggacgaccggaacgccaccgccagcaucaucuacgacggcauccucgucgacuccaucggcagcuggagcaagaacauccugcgcacgcaggaguccaagugcgugugcaucaagcggaccugcaccguggucaagaccgacgggagcgccuccggcaaggccgacacgcgcauccuguucauccgggaggggaagaucgugcacaucagcccgcucuccggcagcgcgcagcacguggaggagugcuccugcuacccccaguaccccgagguccgcugcgugugccgggacaacuggcgcggcagcaaccggcccgugcuguacaucaacauggccgacuacuccaucgacagcggguacgucugcuccggccuggugggggacaccccgcgcaacgacgacaucagcuccagcuccaacugcaaggaccccaacaacgagcggggcgcccccggggugaagggcugggccuucgacagcggcaacgaccucuggauggggcgcaccaucgagaaggagucccggagcggcuacgagaccuuccgcgucaucgggggcuggaacacggccaacuccaagagccagaccagccgccaggugaucguggacuccgacaacagcuccggguacagcggcaucuucuccgucgagggcaagagcugcaucaaccggugcuucuacguggagcugauccgcgggcggcccaaggagacccgcgucugguggaccuccaacagcaucaucguguucugcggcacguccgggaccuacggcaccgggagcuggccggacggcgcgaacaucaacuucauggccaucuga

SEQ ID NO: 84537 - RNA, 1410 nt, Artificial Sequence; identical to SEQ ID NO: 84535
  derived and/or modified sequence opt1 from neuraminidase__InfluenzaA__AGQ81735

SEQ ID NO: 84538 - RNA, 1410 nt, Artificial Sequence
  derived and/or modified sequence opt1 from neuraminidase__InfluenzaA__AGQ81736
augaaccccaaccagaagaucaucgccaucggcagcgugucccugaccaucgccaccaucugccuccugaugcagaucgcgauccuggucgccacgaugacccuccacagcaagcacggggagugcaccgacuccagcaacaaccaggccgugccgugcggccccaucaucaucgagcgcaacgugaccgagaucguccaccugaacuccacgacccuggagaaggagaucugccccaaggccgccggguacaaggacuggagcaagccccagugccagaucaccggcuucgcgccguucuccaaggacaacagcauccggcucuccgccagcggggacaucugggugacccgcgagcccuacguguccugcggccugggcaagugcuaccaguucgcccuggggcagggcacgacccucgacaaccggcacagcaacgggaccucccacgaccgcacgccccaccggacccugcugaugaacgagcucggcguccccuuccaccuggccaccaagcaggucugcaucgcguggagcuccagcuccugccacgacgggaaggccuggcugcacgugugcgugaccggcgacgaccgcaacgccaccgccagcaucaucuacgacggcaugcucguggacuccaucgggagcuggagcaagaacauccugcggacgcaggaguccgagugcgugugcaucaacgggaccugcaccgucgugaugaccgacggcagcgccuccggcaaggcggacacgcgcauccuguucauccgggagggcaagaucgcccacaucagcccgcucuccgggagcgcccagcacguggaggagugcuccugcuacccccaguaccccgagguccgcugcgugugccgggacaacuggcgcggcagcaaccggcccgugcuguacaucaacauggccgacuacuccgucgacagcggguacgugugcuccggccuggugggggacaccccgcgcaacgacgacaccagcuccagcuccaacugcaaggaccccaacaacgagcggggcgcccccggcgucaaggggugggcguucgacagcggcaacgacaucuggauggggcgcaccaucgagaaggacucccggagcggcuacgagacguuccgcgugaucgggggcuggaacaccgccaacuccaagagccagaccagccgccaggugaucgucgacuccgacaacagcuccggcuacagcgggaucuucuccguggagggcaagagcugcaucaaccggugcuucuacgucgagcucauccgggggcgccccaaggagacccgcgugugguggacguccaacagcaucaucguguucugcggcaccuccgggaccuacggcaccggcagcuggccggacggggccaacaucaacuucaugcccaucuga

SEQ ID NO: 84539 - RNA, 1410 nt, Artificial Sequence
  derived and/or modified sequence opt1 from neuraminidase__InfluenzaA__AGQ81737
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacaaccaggccgugccgugcgggcccaucaucaucgagcgcaacaucaccgagaucgugcaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggagcuccagcuccugccacgacggcaaggcguggcugcacgugugcgugaccggggacgaccggaacgccaccgccagcaucaucuacgacggcauccucgucgacuccaucggcagcuggagcaagaacauccugcgcacgcaggaguccgagugcgugugcaucaacgggaccugcaccguggucaugaccgacggcagcgccuccgggaaggccgacacgcggauccuguucauccgcgagggcaagaucgugcacaucagcccgcucuccggcagcgcgcagcacguggaggagugcuccugcuacccccaguaccccgagguccggugcgugugccgcgacaacuggcgggggagcaaccgccccgugcuguacaucaacauggccgacuacuccaucgacagcggcuacgucugcuccgggcuggugggcgacaccccgcggaacgacgacaucagcuccagcuccaacugcaaggaccccaacaacgagcgcggggcccccggcgugaagggcugggccuucgacagcgggaacgaccucuggaugggccggaccaucgagaaggagucccgcagcggguacgagaccuuccgggucaucggcggguggaacacggccaacuccaagagccagaccagccgccaggugaucguggacuccgacaacagcuccggcuacagcggcaucuucuccgucgagggcaagagcugcaucaaccggugcuucuacguggagcugauccgcgggcgccccaaggagacccgggucugguggaccuccaacagcaucaucguguucugcgggacguccggcaccuacgggaccggcagcuggccggacggcgcgaacaucaacuucauggccaucuga

SEQ ID NO: 84540 - RNA, 1410 nt, Artificial Sequence
  derived and/or modified sequence opt1 from neuraminidase__InfluenzaA__AGQ81738
augaaccccaaccagaagaucaucgccaucggcagcgugucccugaccaucgccaccaucugccuccugaugcaggucgcgauccuggugacgaccaugacccuccacuucaagcacaacgagugcagcaacuccagcaacaaccaggccgugccgugcgggcccaucaucaucgagcgcaacaucaccgagaucguccaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggugacccgggagcccuacguguccugcgggcugggcaagugcuaccaguucgcccugggccaggggacgacccucgacaaccgccacagcaacggcaccucccacgaccggacgccccaccgcacccugcugaugaacgagcucgggguccccuuccaccuggccaccaagcaggucugcaucgccuggagcuccagcuccugccacgacggcaaggcguggcugcacgugugcgugaccggggacgaccggaacgccaccgccagcaucaucuacgacggcauccucguggacuccaucggcagcuggagcaagaacauccugcgcacgcaggaguccgagugcgugugcaucaacgggaccugcaccgucgugaugaccgacggcagcgccuccgggaaggccgacacgcggauccuguucauccgcgagggcaagaucauccacaucagcccgcucuccggcagcgcgcagcacguggaggagugcuccugcuacccccaguaccccgagguccggugcgugugccgcgacaacuggcgggggagcaaccgccccgugcuguacaucaacauggccgacuacuccaucgacagcggcuacgucugcuccgggcuggugggcgacaccccgcggaacgacgacaucagcuccagcuccaacugcaaggaccccaacaacgagcgcggggcccccggcgugaagggcugggccuucgacagcgggaacgaccucuggaugggccggaccaucgagaaggagucccgcagcggguacgagaccuuccgggucaucggcggguggaacacggccaacuccaagagccagaccagccgccaggugaucguggacuccgacaacagcuccggcuacagcggcaucuucuccgucgagggcaagagcugcaucaaccggugcuucuacguggagcugauccgcgggcgccccaaggagacccgggucugguggaccuccaacagcaucaucguguucugcgggacguccggcaccuacgggaccggcagcuggccggacggcgcgaacaucaacuucaugcccaucuga

SEQ ID NO: 84541 - RNA, 1410 nt, Artificial Sequence
  derived and/or modified sequence opt1 from neuraminidase__InfluenzaA__AGQ81739
augaaccccaaccagaagaucaucgccaucggcagcgugucccugaccaucgccaccaucugccuccugaugcagaucgcgauccuggucacgaccaugacccuccacuucaagcacgacgagugcaccaacagcuccaacaaccaggccgugccgugcgagcccaucaucaucgagcgcaacgugacggagaucguccacaucaacagcaccauccuggagaaggagaucugccccaaggccgccggguaccggaacugguccaagccccagugccagaucaccggcuucgccccguucagcaaggacaacuccauccgccugagcgcguccggggacaucugggugacccgggagcccuacgugagcugcggccucgggaagugcuaccaguucgcccugggccagggcacgacccuggacaaccgccacuccaacgggacccucaacgaccggacgccccaccgcacccugcugaugaacgagcucggcguccccuuccaccuggccaccaagcaggucugcaucgccuggagcuccagcuccugccacgacgggaaggcguggcugcacgugugcgugaccggcgacgaccggaacgccaccgccagcaucaucuacgacgacaugcucguggacuccaucgggagcugguccaagaacauccugcgcacgcaggagagcgagugcgugugcaucaacgggaccugcaccgucgugaugaccgacggcagcgccuccggcaaggccgacacgcggauccuguucauccgcgagggcaagaucgugcacaucagcccgcucuccgggagcgcgcagcacgucgaggagugcuccugcuacccccaguaccccgaggugcggugcgugugccgcgacaacuggcggggcagcaaccgccccguccuguacaucaacauggccgacuacuccaucgacagcggcuacgugugcuccgggcuggugggcgacaccccgcggaacgacgacaucagcuccagcuccaacugcaaggaccccaacaacgagcgcggggcccccggcgucaaggggugggccuucgacagcggcaacgacaucuggaugggccggaccaucgagaaggacucccgcagcggguacgagaccuuccgggugaucggcggguggaacacggccaacuccaagagccagaccucccgccaggugaucgucgacagcgacaacagcuccggcuacagcgggaucuucuccguggagggcaagagcugcaucaaccggugcuucuacgucgagcucauccgcggccgccccaaggagacccgggugugguggaccuccaacagcaucaucguguucugcgggacguccggcaccuacgggaccggcagcuggccggacggggcgaacaucaacuucauggccaucuga

SEQ ID NO: 84542 - RNA, 1410 nt, Artificial Sequence
  derived and/or modified sequence opt1 from neuraminidase__InfluenzaA__AGQ81740
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggagaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccacggccuccaucaucuacaacggcauccucguggacagcaucggguccuggagcaagaacauccugcgcacccaggagagcgagugcgugugcaucaacgggaccugcaccgucgugaugacggacggcuccgccagcggcaaggccgacacccggauccuguucauccgcgagggcaagaucgugcacaucuccccgcucagcggguccgcgcagcacgucgaggagugcagcugcuacccccaguaccccgaggugcggugcgugugccgcgacaacuggcggggcuccaaccgccccguccuguacaucaacauggccgacuacagcguggacuccggguacgugugcagcggccuggucggggacaccccgcggaacgacgacaccuccagcuccagcaacugcaaggaccccaacaacgagcgcggcgcccccggcgugaaggggugggccuucgacuccggcaacgacaucuggauggggcggacgaucgagaaggaccuccgcagcggcuacgagaccuuccgggugaucgggggcuggaacaccgccaacuccaagagccagaccucccgccaggucaucguggacagcgacaacagcuccggcuacagcgggaucuucuccgucgagggcaagagcugcaucaaccggugcuucuacguggagcugauccgcgggcgccccaaggagacgcgggugugguggaccuccaacagcaucaucgucuucugcggcaccuccgggaccuacggcacgggcagcuggccggacggggcgaacaucaacuucaugcccaucuga

SEQ ID NO: 84543 - RNA, 1410 nt, Artificial Sequence
  derived and/or modified sequence opt1 from neuraminidase__InfluenzaA__AGQ81741
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggacaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccacggccuccaucaucuacgacggcaugcucguggacagcaucggguccuggagcaagaacauccugcgcacccaggagagcgagugcgugugcaucaacgggaccugcaccgucgugaugacggacggcuccgccagcggcaaggccgacacccggauccuguucauccgcgagggcaagaucgugcacaucuccccgcucagcggguccgcgcagcacgucgaggagugcagcugcuacccccaguaccccgaggugcggugcgugugccgcgacaacuggcggggcuccaaccgccccguccuguacaucaacauggccgacuacagcguggacuccggguacgugugcagcggccuggucggggacaccccgcggaacgacgacaccuccagcuccagcaacugcaaggaccccaacaacgagcgcggcgcccccggcgugaaggggugggccuucgacuccggcaacgacaucuggauggggcggacgaucgagaaggaccuccgcagcggcuacgagaccuuccgggugaucgggggcuggaacaccgccaacuccaagagccagaccucccgccaggucaucguggacagcgacaacagcuccggcuacagcgggaucuucuccgucgagggcaagagcugcaucaaccggugcuucuacguggagcugauccgcgggcgccccaaggagacgcgggugugguggaccuccaacagcaucaucgucuucugcggcaccuccgggaccuacggcacgggcagcuggccggacggggcgaacaucaacuucaugcccaucuga

SEQ ID NO: 84544 - RNA, 1410 nt, Artificial Sequence
  derived and/or modified sequence opt1 from neuraminidase__InfluenzaA__AGQ81742
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggagaaggagaucugccccaaggccgccgaguaccgggacugguccaagccccagugccagaucaccggguucgccccguucagcaaggacaacuccauccgccucagcgcguccggcgacaucugggugacgcgggagcccuacgugagcugcgggcugggcaagugcuaccaguucgcccugggccaggggaccacccucgacaaccgccacuccaacggcaccagccacgaccggacgccccaccgcacccugcugaugaacgagcucgggguccccuuccaccuggccaccaagcaggucugcaucgccugguccagcuccagcugccacgacggcaaggcguggcugcacgugugcgugaccggggacgaccggaacgccacggccuccaucaucuacgacggcaugcucguggacagcaucggcuccuggagcaagaacauccugcgcacccaggagagcgagugcgugugcaucaacgggaccugcaccgucgugaugacggacggcuccgccagcgggaaggccgacacccggauccuguucauccgcgagggcaagaucgugcacaucuccccgcucagcggcuccgcgcagcacgucgaggagugcagcugcuacccccaguaccccgaggugcggugcgugugccgcgacaacuggcggggguccaaccgccccguccuguacaucaacauggccgacuacagcguggacuccggcuacgugugcagcgggcuggucggcgacaccccgcggaacgacgacaccuccagcuccagcaacugcaaggaccccaacaacgagcgcggggcccccggcgugaagggcugggccuucgacuccgggaacgacaucuggaugggccggacgaucgagaaggaccuccgcagcggguacgagaccuuccgggugaucggcggguggaacaccgccaacuccaagagccagaccucccgccaggucaucguggacagcgacaacagcuccggcuacagcggcaucuucuccgucgagggcaagagcugcaucaaccggugcuucuacguggagcugauccgcgggcgccccaaggagacgcgggugugguggaccuccaacagcaucaucgucuucugcgggaccuccggcaccuacgggacgggcagcuggccggacggcgcgaacaucaacuucaugcccaucuga

SEQ ID NO: 84545 - RNA, 1410 nt, Artificial Sequence
  derived and/or modified sequence opt1 from neuraminidase__InfluenzaA__AGQ81744
augaaccccaaccagaagaucaucgccaucggcagcgugucccugaccaucgccaccaucugccuccugaugcagaucgcgauccuggucacgaccaugacccuccacuuccgccacgacgagugcaccaacagcuccaacaaccaggccgugccgugcgggcccaucaucaucgagcggaacgugacggagaucguccaccugaacagcaccacccuggagaaggagaucugccccaaggccgccgaguaccgcgacugguccaagccccagugccagaucaccggcuucgugccguucagcaaggacaacuccauccggcucagcgccgggggcgacaucugggugacgcgcgagcccuacgucuccugcgggcugggcaagugcuaccaguucgcgcugggccaggggaccacccucgacaaccggcacagcaacggcaccucccacgaccgcacgccccaccggacccugcugaugaacgagcucggggugcccuuccaccuggccaccaagcaggucugcaucgccuggagcuccagcuccugccacgacggcaaggccuggcugcacgugugcgugaccggggacgaccgcaacgcgacggccagcaucaucuacgacggcaugcucguggacuccaucggcagcugguccaagaacauccugcggacccaggagagcgagugcgucugcaucaacgggaccugcaccguggugaugacggacggcagcgccuccgggaaggccgacacccgcauccuguucauccgggagggcaagaucguccacaucagcccgcucuccggcagcgcccagcacguggaggagugcuccugcuacccccaguaccccgaggugcgcugcgucugccgggacaacuggcgcgggagcaaccggcccgugcuguacaucaacguggcggacuacuccgucgacagcggcuacgugugcuccgggcuggugggcgacaccccgcgcaacgacgacaucagcuccagcuccaacugcaaggaccccaacaacgagcgcggggcccccggcgucaagggcugggccuucgacagcgggaacgacaucuggaugggccggaccaucgagaaggacucccggagcggguacgagacguuccgcgugaucggcggguggaacaccgccaacuccaagagccagaccucccggcaggucaucguggacagcgacaaccccagcggcuacuccggcaucuucagcguggaggggaaguccugcaucaaccgcugcuucuacgucgagcucauccgcggccggccgaaggagacccgcgugugguggacgagcaacuccaucaucguguucugcgggaccagcggcaccuacgggaccggcuccuggcccgacggcgccaacaucaacuucaugcccaucuga

SEQ ID NO: 84546 - RNA, 1410 nt, Artificial Sequence
  derived and/or modified sequence opt1 from neuraminidase__InfluenzaA__AGQ81746
augaaccccaaccagaagaucaucgccaucggcagcgugucccugaccaucgccaccaucugccuccugaugcagaucgcgauccuggucacgaccaugacccuccacuucaagcacaacgagugcagcaacuccagcaacucccaggccgugccgugcgggcccaucaucaucgagcgcaacgugaccgagaucguccaccugaacagcacgacccuggagaaggagaucugccccaaggccgccgaguaccggggcugguccaagccccagugccagaucaccggguucgccccguucagcaaggacaacuccauccgccucagcgcguccggcgacaucugggugacccgggagcccuacgugagcugcgaccuggggaagugcuaccaguucgcccugggccagggcacgacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccaccgccuccaucaucuacgacgggauccucguggacagcaucggcagcugguccaagaacauccugcgcacgcaggagagcgagugcgugugcaucaacgggaccugcaccgucgugaugaccgacggcuccgccagcggcaaggccgacacgcggauccuguucauccgcgaggggaagaucgugcacaucuccccgcucagcggcuccgcgcagcacgucgaggagugcagcugcuacccccaguaccccgaggugcggugcgugugccgcgacaacuggcggggcuccaaccgccccguccuguacaucaacauggccgacuacagcaucgacuccggguacgugugcagcggccuggugggggacaccccgcggaacgacgacaucuccagcuccagcaacugcaaggaccccaacaacgagcgcggcgcccccggggucaagggcugggccuucgacuccggcaacgaccucuggauggggcggaccaucgagaaggacagccgcuccggcuacgagaccuuccgggugaucgggggcuggaacacggccaacagcaagagccagaccucccgccaggugaucgucgacagcgacaacuccagcggguacuccggcaucuucagcguggagggcaaguccugcaucaaccggugcuucuacgucgagcugauccgcgggcgccccaaggagacccgggugugguggaccagcaacuccaucaucguguucugcggcacgagcgggaccuacggcaccggguccuggccggacggcgcgaacaucaacuucaugcccaucuga

SEQ ID NO: 84547 - RNA, 1410 nt, Artificial Sequence
  derived and/or modified sequence opt1 from neuraminidase__InfluenzaA__AGQ81747
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggagaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccacggccuccaucaucuacgacggcaugcucguggacagcaucggguccuggagcaagaacauccugcgcacccaggagagcgagugcgugugcaucaacgggaccugcaccgucgugaugacggacggcuccgccagcggcaaggccgacacccggauccuguucauccgcgagggcaagaucgugcacaucuccccgcucagcggguccgcgcagcacgucgaggagugcagcugcuacccccaguaccccgaggugcggugcgugugccgcgacaacuggcggggcuccaaccgccccguccuguacaucaacauggccgacuacagcguggacuccggguacgugugcagcggccuggucggggacaccccgcggaacgacgacaccuccagcuccagcaacugcaaggaccccaacaacgagcgcggcgcccccggcgugaaggggugggccuucgacuccggcaacgacaucuggauggggcggacgaucgagaaggaccuccgcagcggcuacgagaccuuccgggugaucgggggcuggaacaccgccaacuccaagagccagaccucccgccaggucaucguggacagcgacaacagcuccggcuacagcgggaucuucuccgucgagggcaagagcugcaucaaccggugcuucuacguggagcugauccgcgggcgccccaaggagacgcgggugugguggaccuccaacagcaucaucgucuucugcggcaccuccgggaccuacggcacgggcagcuggccggacggggcgaacaucaacuucaugcccaucuga

SEQ ID NO: 84548 - RNA, 1401 nt, Artificial Sequence
  derived and/or modified sequence opt1 from neuraminidase__InfluenzaA__AGQ81749
augaaccccaaccagaagaucaucgccaucggcagcgugucccugaccaccgccaucaucugcuuccucaugcagaucgcgauccugacgaccaccaugacccugcacuucaagcagaacgagugcagcaacccguccaacaaccaggucgugcccugcgagcccaucaucaucgagcgcaacacggugcaccucaacagcaccaccaucgagaaggagaucugcuccaaggucgccgaguacaagaacuggagcaagccccagugccagaucaccggguucgccccguucuccaaggacaacagcauccggcuguccgccggcggggacaucugggugacgcgcgagcccuacgugagcugcucccugggcaagugcuaccaguucgcccucgggcagggcaccacccugaagaacaagcacagcaacggcaccacgcacgaccggaucccccaccgcacccugcucaugaacgagcuggggguccccuuccaccugggcaccaagcaggucugcaucgcgugguccagcuccagcugcuacgacgggaaggccuggcuccacaucugcgugaccggcgacgacaagaacgccacggccuccaucaucuacgacgggaugcuggcggacagcaucggcuccuggagcaagaacauccugcggacccaggagagcgagugcgugugcaucaacgggaccugcgccguggugaugaccgacggguccgccagcggcaaggccgacacgcgcauccucuucauccgggaggggcgcaucaucaacaucuccccgcugagcggcuccgcccagcacgucgaggagugcagcugcuacccccgguaccccgaggugcgcugcgugugccgggacaacuggaagggcuccaaccgccccguccuguacaucaacauggcggacuacagcguggaguccagcuacgugugcuccgggcucgucggcgacaccccgcggaacgacgacagcuccagcuccagcaacugccgcgaccccaacaacgagcggggcgcccccggcgugaaggggugggccuucgacgacggcaacgacguguggaugggccgcaccaucaagaaggacucccggagcggguacgagaccuuccgcgucaucaacggcuggacgaccgccaacuccaagagccagaucaaccgccaggugaucguggacagcgacaacugguccggguacagcggcaucuucuccgucgaggggaagaacugcaucaaccggugcuucuacguggagcugauccggggccgcccccaggagccgaaggucugguggaccagcaacuccaucaucgccuucugcggcaccagcgggacguacggcaccggguccuggcccgacggcgcgaacaucaacuucaugcccaucuga

SEQ ID NO: 84549 - RNA, 1401 nt, Artificial Sequence; identical to SEQ ID NO: 84548
  derived and/or modified sequence opt1 from neuraminidase__InfluenzaA__AGQ81750

SEQ ID NO: 84550 - RNA, 1410 nt, Artificial Sequence
  derived and/or modified sequence opt1 from neuraminidase__InfluenzaA__AGQ81751
augaaccccaaccagaagaucaucgccaucggcagcgugucccugaccaucgccaccaucugccuccugaugcagaucgcgauccuggucacgaccaugacccucuacuucaagcacaacgagugcagcaacuccagcaacaaccaggccgugccgugcgggcccaucaucaucgagcgcaacaucaccgagaucgugcaccugaacuccacgacccuggagaaggagaucugccccaaggccgccggcuaccgggacuggagcaagccccagugccagaucaccggguucgccccguucuccaaggacaacagcauccgccucuccgcgagcggcgacaucugggucacccgggagcccuacguguccugcgggcugggcaagugcuaccaguucgcccugggccaggggacgacccucgacaaccgccacagcaacggcaccucccacgaccggacgccccaccgcacccugcugaugaacgagcucggggugcccuuccaccuggccaccaagcaggucugcaucgccuggagcuccagcuccugccacgacggcaaggcguggcugcacgugugcgugaccggggacgaccggaacgccaccgccagcaucaucuacgacggcauccucgucgacuccaucggcagcuggagcaagaacauccugcgcacgcaggaguccgagugcgugugcaucaacgggaccugcaccguggucaugaccgacggcagcgccuccgggaaggccgacacgcggauccuguucauccgcgagggcaagaucgugcacaucagcccgcucuccggcagcgcgcagcacguggaggagugcuccugcuacccccaguaccccgagguccggugcgugugccgcgacaacuggcgggggagcaaccgccccgugcuguacaucaacauggccgacuacuccaucgacagcggcuacgucugcuccgggcuggugggcgacaccccgcggaacgacgacaucagcuccagcuccaacugcaaggaccccaacaacgagcgcggggcccccggcgugaagggcugggccuucgacagcgggaacgaccucuggaugggccggaccaucgagaaggagucccgcagcggguacgagaccuuccgggucaucggcggguggaacacggccaacuccaagagccagaccagccgccaggugaucguggacuccgacaacagcuccggcuacagcggcaucuucuccgucgagggcaagagcugcaucaaccggugcuucuacguggagcugauccgcgggcgccccaaggagacccgggucugguggaccuccaacagcaucaucguguucugcgggacguccggcaccuacgggaccggcagcuggccggacggcgcgaacaucaacuucaugcccaucuga

SEQ ID NO: 84551 - RNA, 1410 nt, Artificial Sequence
  derived and/or modified sequence opt1 from neuraminidase__InfluenzaA__AGQ81753
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggggaucguccaccugaacagcaccacccuggagaaggagaucugccccaaggccgccggcuaccgggacugguccaagccccagugccagaucaccggguucgccccguucagcaaggacaacuccauccgccucagcgcguccggcgacaucugggugacgcgggagcccuacgugagcugcggccuggggaagugcuaccaguucgcccugggccaggggaccacccucgacaaccgccacuccaacggcaccagccacgaccggacgccccaccgcacccugcugaugaacgagcucgggguccccuuccaccuggccaccaagcaggucugcaucgccugguccagcuccagcugccacgacggcaaggcguggcugcacaucugcgugaccggcgacgaccggaacgccacggccuccaucaucuacgacgggaugcucguggacagcaucggcuccuggagcaagaacauccugcgcacccaggagagcgagugcgugugcaucaacgggaccugcaccguggucaugacggacggcuccgccagcggcaaggccgacacccggauccuguucauccgcgaggggaagaucgugcacaucuccccgcucagcggcuccgcgcagcacguggaggagugcagcugcuacccccaguaccccgagguccggugcgugugccgcgacaacuggcggggguccaaccgccccgugcuguacaucaacauggccgacuacagcgucgacuccggcuacgugugcagcgggcuggugggcgacaccccgcggaacgacgacaccuccagcuccagcaacugcaaggaccccaacaacgagcgcggcgcccccggggucaagggcugggccuucgacuccgggaacgacaucuggaugggccggacgaucgagaaggaccuccgcagcggguacgagaccuuccgggugaucggcggcuggaacaccgccaacuccaagagccagaccaaccgccaggugaucgucgacuccgacaacagcagcggguacuccggcaucuucagcguggaggggaaguccugcaucaaccggugcuucuacgucgagcugauccgcggccgccccaaggagacgcgggugugguggaccagcaacuccaucaucguguucugcgggaccagcggcaccuacggcacgggguccuggccggacggcgcgaacaucaacuucaugcccaucuga

SEQ ID NO: 84552 - RNA, 1410 nt, Artificial Sequence; identical to SEQ ID NO: 84551
  derived and/or modified sequence opt1 from neuraminidase__InfluenzaA__AGQ81754

SEQ ID NO: 84553 - RNA, 1410 nt, Artificial Sequence
  derived and/or modified sequence opt1 from neuraminidase__InfluenzaA__AGQ81756
augaaccccaaccagaagaucaucgccaucggcagcaucucccugaccaucgccaccaucugccuccugauccagaucgcgauccuggugacgaccaugacccuccacuucaagcacggggagugcaccaacagcuccaacaaccaggccgucccgugcggccccaucaucaucgagcgcaacgugacggagaucgugcaccugaacagcaccacccuggagaaggagaucugccccaaggccgccggguaccgggacugguccaagccccagugccagaucaccggcuucgccccguucagcaaggacaacuccauccgccucagcgcguccggggacaucugggucacgcgggagcccuacgugagcugcggccugggcaagugcuaccaguucgcccuggggcagggcaccacccucgacaaccgccacuccaacgggaccagccacgaccggacgccccaccgcacccugcugaugaacgagcucggcgugcccuuccaccuggccaccaagcaggucugcaucgccugguccagcuccagcugccacgacgggaaggcguggcugcacgugugcgugaccggcgacgaccggaacgccacggccuccaucaucuacgacggccuccuggucgacagcaucggguccuggagcaagaacauccugcgcacccaggagagcgagugcgugugcaucaacgggaccugcaccguggucaugacggacggcuccgccagcggcaaggccgacacccggauccucuucauccgcgagggcaagaucauccacaucuccccgcugagcggguccgcgcagcacguggaggagugcagcugcuacccccaguaccccgaggugcggugcgucugccgcgacaacuggcggggcuccaaccgccccgugcuguacaucaacauggccgacuacagcguggacuccggguacgucugcagcggccucgugggggacaccccgcggaacgacgacaccuccagcuccagcaacugcaaggaccccaacaacgagcgcggcgcccccggcgugaaggggugggccuucgacuccggcaacgacaucuggauggggcggacgaucgagaaggacagccgcuccggcuacgagaccuuccgggucaucgggggcuggaacaccgccaacagcaagucccagaccagccgccaggugaucguggacagcgacaacuccagcggcuacuccgggaucuucagcgucgagggcaaguccugcaucaaccggugcuucuacguggagcugauccgcgggcgccccaaggagacgcgggucugguggaccagcaacuccaucaucguguucugcggcaccagcgggaccuacggcacgggcuccuggccggacggggcgaacaucaacuucaugcccaucuga

SEQ ID NO: 84554 - RNA, 1410 nt, Artificial Sequence
  derived and/or modified sequence opt1 from neuraminidase__InfluenzaA__AGQ81757
augaaccccaaccagaagaucaucgccaucggcagcgugucccugaccaucgccaccaucugccuccugauccagaucgcgauccuggucacgaccaugacccuccacuucaagcacggggagugcaccaacagcuccaacaaccaggccgugccgugcggccccaucaucaucgagcgcaacgugacggagaucguccaccugaacagcaccacccuggagaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugaugaacgagcucggcguccccuuccaccuggccaccaagcaggucugcaucgccugguccagcuccagcugccacgacgggaaggcguggcugcacgugugcgugaccggcgacgaccggaacgccacggccuccaucaucuacgacggccuccugguggacagcaucggguccuggagcaagaacauccugcgcacccaggagagcgagugcgugugcaucaacgggaccugcaccgucgugaugacggacggcuccgccagcggcaaggccgacacccggauccucuucauccgcgagggcaagaucauccacaucuccccgcugagcggguccgcgcagcacguggaggagugcagcugcuacccccaguaccccgagguccggugcgugugccgcgacaacuggcggggcuccaaccgccccgugcuguacaucaacauggccgacuacagcgucgacuccggguacgugugcagcggccucgugggggacaccccgcggaacgacgacaccuccagcuccagcaacugcaaggaccccaacaacgagcgcggcgcccccggcgucaaggggugggccuucgacuccggcaacgacaucuggauggggcggacgaucgagaaggacagccgcuccggcuacgagaccuuccgggugaucgggggcuggaacaccgccaacagcaagucccagaccagccgccaggugaucgucgacagcgacaacuccagcggcuacuccgggaucuucagcguggagggcaaguccugcaucaaccggugcuucuacgucgagcugauccgcgggcgccccaaggagacgcgggugugguggaccagcaacuccaucaucguguucugcggcaccagcgggaccuacggcacgggcuccuggccggacggggcgaacaucaacuucaugcccaucuga

SEQ ID NO: 84555 - RNA, 1401 nt, Artificial Sequence
  derived and/or modified sequence opt1 from neuraminidase__InfluenzaA__AGQ81758
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucgugcccugcgagcccaccaucaucgagcggaacaccgugcaccugaacagcacgaccaucgagcgcgagaucugccccaaggucgccgaguacaagaacugguccaagccgcagugccagaucaccggguucgcccccuucagcaaggacaacuccauccggcugagcgccggcggggacaucugggugacccgcgagcccuacguguccugcagccucggcaagugcuaccaguucgcccuggggcagggcacgacccugaagaacaagcacuccaacggcaccacccacgaccggacgccccaccgcacccuccugaugaacgagcugggggucccguuccaccucggcaccaagcaggucugcaucgcguggagcuccagcuccugcuacgacgggaaggccuggcugcacaucugcgugaccggcgacgacgagaacgccacggccagcaucaucuacgacgggaugcugguggacuccaucggcagcugguccaagaacauccuccggacccaggagagcgagugcgugugcaucaacgggaccugcgcgguggucaugaccgacggcagcgccuccggcaaggccgacacgcgcgugcuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccaucgagagcuccuacgucugcagcgggcuggugggcgacacgccccgcaacgacgacuccagcuccagcuccaacugccgggaccccaacaacgagcgcggggcgcccggcgugaaggggugggccuucgacgacggcaacgacgucuggaugggccggaccaucaagaacgacagccgcuccggguacgagaccuuccggguggugaacggcuggaccauggccaacagcaagucccagaucaaccgccaggucaucguggacagcgacaacuggagcggguacuccggcaucuucagcgucgaggggaagaagugcaucaaccggugcuucuacguggagcugauccgcggccgcccgcaggagccccgggugugguggaccuccaacagcaucaucgucuucugcggcaccuccgggaccuacggcacggggagcuggcccgacggcgccaacaucaacuucaugcccaucuga

SEQ ID NO: 84556 - RNA, 1401 nt, Artificial Sequence
  derived and/or modified sequence opt1 from neuraminidase__InfluenzaA__AGQ81759
augaaccccaaccagaagaucaucgccaucggcagcgugucccugaccaucgccaucaucugcuuccucauccagaucgcgauccugaccacgaccaugacccugcacuuccgccagagcgagugcuccaacccgagcaacaaccaggucgugcccugcgagcccaucaucaucgagcggaacaccgugcaccucaacuccacgaucaucgagaaggagaucugccccaaggucgccgaguacaagaacuggagcaagccgcagugccagaucaccggguucgcccccuucuccaaggacaacagcauccgccuguccgccggcggggacaucugggugacccgggagcccuacgugagcugcucccugggcaagugcuaccaguucgcccucgggcagggcaccacgcugaagaacaagcacagcaacggcaccacccacgaccgcaucccccaccggacccugcucaugaacgagcugggggucccguuccaccugggcacgaagcaggucugcaucgcgugguccagcuccagcugccacgacgggaaggccuggcuccacaucugcgugaccggcgacgacaagaacgccaccgccuccaucaucuacgacgggaugcugguggacagcaucggcuccuggagcaagaacauccugcgcacccaggagagcgagugcgugugcaucaacggcacgugcgcgguggucaugaccgacggguccgccagcggcaaggccgacacccggauccucuucauccgcgaggggaagaucaucaacaucagcccccuguccggcuccgcccagcacguggaggagugcagcugcuacccccgguaccccgaggugcgcugcgucugccgggacaacuggaagggcuccaaccgcccggugcuguacaucaacauggccgacuacagcaucgaguccagcuacgugugcuccgggcucgucggcgacacgccccgggacgacgacagcuccagcuccagcaacugccgcgaccccaacaacgagcgcggggcgcccggcgugaaggggugggccuucgacgacggcaacgacaucuggaugggccggaccaucaaguccgacagccgguccggguacgagaccuuccgcgugaucaacggcuggaccaccgccaacagcaagagccagaucaaccggcaggucaucguggacuccgacagcugguccggguacagcggcaucuucuccguggaggggaagaacugcaucaaccgcugcuucuacgucgagcugauccggggccgcccgcgcgagacgcgggugugguggaccagcaacuccaucaucgucuucugcggcaccagcgggaccuacggcacgggguccuggcccgacggcgccaacaucaacuucaugcccaucuga

SEQ ID NO: 84557 - RNA, 1401 nt, Artificial Sequence
  derived and/or modified sequence opt1 from neuraminidase__InfluenzaA__AGQ81760
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacgggagcgccuccggcaaggccgacacccggguccucuucauccgcgaggggaagaucaucaacaucagcccccuguccggcagcgcccagcacguggaggagugcuccugcuacccccgguaccccgaggugcgcugcgugugccgggacaacuggaagggcagcaaccgcccggugcuguacaucaacauggccgacuacuccaucgagagcuccuacgucugcagcgggcucgugggcgacacgccccgggacgacgacuccagcuccagcuccaacugccgcgaccccaacaacgagcggggcgcgcccggcgugaaggggugggccuucgacgacggcaacgacaucuggaugggccgcaccaucaagagcgacucccggagcggguacgagaccuuccgcgucgugaacggcuggaucaccgccaacuccaagagccagaucaaccgccaggugaucgucgacagcgacuccuggagcggguacuccggcaucuucagcguggaggggaagaacugcaucaaccggugcuucuacgucgagcugauccggggccgcccgcaggagacgcgcgugugguggaccuccaacagcaucaucguguucugcggcaccuccgggaccuacggcacggggagcuggcccgacggcgccaacaucaacuucaugcccaucuga

SEQ ID NO: 84558 - RNA, 1401 nt, Artificial Sequence
  derived and/or modified sequence opt1 from neuraminidase__InfluenzaA__AGQ81761
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacggcagcgccuccggcaaggccgacacccggauccucuucaucaaggaggggaagaucaucaacaucagcccccuguccggcagcgcccagcacguggaggagugcuccugcuacccccgcuaccccgaggugcggugcgucugccgcgacaacuggaagggcagcaaccggccggugcuguacaucaacauggccgacuacuccaucgagagcuccuacgugugcagcgggcucgucggcgacacgccccgcgacgacgacuccagcuccagcuccaacugccgggaccccaacaacgagcgcggggcgcccggcgugaaggggugggccuucgacgacggcaacgacaucuggaugggccggaccaucaagagcgacucccgcagcggguacgagaccuuccggguggucaacggcuggaccacggccaacuccaagagccagaucaaccgccaggugaucguggacagcgacuccuggagcggguacuccggcaucuucagcgucgaggggaagaacugcaucaaccggugcuucuacguggagcugauccgcggccggccgcaggagacccgcgucugguggaccuccaacagcaucaucguguucugcggcaccuccgggacguacggcaccgggagcuggcccgacggcgccaacaucaacuucaugcccaucuga

SEQ ID NO: 84559 - RNA, 1401 nt, Artificial Sequence
  derived and/or modified sequence opt1 from neuraminidase__InfluenzaA__AGQ81763
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucgugcccugcgagcccaucaucaucgagcggaacaccgugcaccugaacagcaccacgaucgagcgcgagaucugccccaaggucgccgaguacaagaacugguccaagccgcagugccagaucaccggguucgcccccuucagcaaggacaacuccauccggcugagcgccggcggggacaucugggugacccgcgagcccuacguguccugcagccucggcaagugcuaccaguucgcccuggggcagggcaccacgcugaagaacaagcacuccaacggcaccacccacgaccggacgccccaccgcacccuccugaugaacgagcugggggucccguuccaccucggcaccaagcaggucugcaucgcguggagcuccagcuccugcuacgacgggaaggccuggcugcacaucugcgugaccggcgacgacaagaacgccaccgccagcaucaucuacgacgggaugcugguggacuccaucggcagcugguccaagaacauccuccggacgcaggagagcgagugcgugugcaucaacgggaccugcgcgguggucaugaccgacggcagcgccuccggcaaggccgacacccgcgugcuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccaucgagagcuccuacgucugcagcgggcuggugggcgacacgccccgcaacgacgacuccagcuccagcuccaacugccgggaccccaacaacgagcgcggggcgcccggcgugaaggggugggccuucgacgacggcaacgacgucuggaugggccggaccaucaagaacgggagccgcuccggcuacgagaccuuccggguggugaacggguggaccauggccaacagcaagucccagaucaaccgccaggucaucguggacagcgacaacuggagcggcuacuccgggaucuucagcgucgagggcaagaagugcaucaaccggugcuucuacguggagcugauccgcggccgcccgcaggagccccgggugugguggacguccaacagcaucaucgucuucugcgggaccuccggcaccuacgggaccggcagcuggcccgacggggccaacaucaacuucaugcccaucuga

SEQ ID NO: 84560 - RNA, 1401 nt, Artificial Sequence
  derived and/or modified sequence opt1 from neuraminidase__InfluenzaA__AGQ81766
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacgggagcgccuccggcaaggccgacacccggauccucuucauccgcgaggggaagaucaucaacaucagcccccuguccggcagcgcccagcacguggaggagugcuccugcuacccccgguaccccgaggugcgcugcgucugccgggacaacuggaagggcagcaaccgcccggugcuguacaucaacauggccgacuacuccaucgagagcuccuacgugugcagcgggcucgucggcgacacgccccgggacgacgacuccuucagcuccagcaacugccgcgaccccaacaacgagcggggcgcgcccggcgugaaggggugggccuucgacgacggcaacgacaucuggaugggccgcaccaucaaguccgacagccgguccggguacgagaccuuccgcguggucaacggcuggaccacggccaacagcaagucccagaucaaccgccaggugaucguggacagcgacagcugguccggguacagcggcaucuucuccgucgaggggaagaacugcaucaaccggugcuucuacguggagcugauccggggccgcccgcaggagaccaucgucugguggaccagcaacuccaucaucguguucugcggcaccagcgggacguacggcaccggguccuggcccgacggcgccaacaucaacuucaugcccaucuga

SEQ ID NO: 84561 - RNA, 1401 nt, Artificial Sequence; identical to SEQ ID NO: 84560
  derived and/or modified sequence opt1 from neuraminidase__InfluenzaA__AGQ81767

SEQ ID NO: 84562 - RNA, 1410 nt, Artificial Sequence
  derived and/or modified sequence opt1 from neuraminidase__InfluenzaA__AGQ81768
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggagaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugauguccgagcucggcguccccuuccaccuggccaccaagcaggucugcaucgccuggagcuccagcuccugccacgacggggaggcguggcugcacaucugcgugaccggcgacgaccggaacgccacggccagcaucaucuacgacggcaugcucguggacuccaucgggagcuggagcaagaacauccugcgcacccaggaguccgagugcgugugcaucaacgggaccugcaccguggucaugacggacggcagcgccuccggcaaggccgacacccggauccuguucauccgcgagggcaagaucgugcacaucagcccgcucuccgggagcgcgcagcacguggaggagugcuccugcuacccccaguaccccgagguccggugcgugugccgcgacaacuggcggggcagcaaccgccccgugcuguacaucaacauggccgacuacuccgucgacagcggguacgugugcuccggccuggugggggacaccccgcggaacgacgacaccagcuccagcuccaacugcaaggaccccaacaacgagcgcggcgcccccggcgucaaggggugggccuucgacagcggcaacgacaucuggauggggcggacgaucgagaaggaccuccgcuccggcuacgagaccuuccgggugaucgggggcuggaacaccgccaacagcaagucccagaccaaccgccaggugaucgucgacagcgacaacagcuccggcuacagcgggaucuucuccguggagggcaagagcugcaucaaccggugcuucuacgucgagcugauccgcgggcgccccaaggagacgcgggugugguggaccuccaacagcaucaucguguucugcggcaccuccgggaccuacggcacgggcagcuggccggacggggcgaacaucaacuucaugcccaucuga

SEQ ID NO: 84563 - RNA, 1410 nt, Artificial Sequence
  derived and/or modified sequence opt1 from neuraminidase__InfluenzaA__AGQ81769
augaaccccaaccagaagaucguggccaucggcagcgucucccugaccaucgccaccaucugccuccugaugcagaucgcgauccuggugacgaccaugacccuccacuucaagcacggggagugcaccaacagcuccaacaaccaggccgugccgugcggccccaucaucaucgagcgcaacaucacggagaucguccaccugaacagcaccacccuggagaaggagaucugccccaaggccgccggguaccgggacugguccaagccccagugccagaucaccggcuucgccccguucagcaaggacaacuccauccgccucagcgcguccggggacaucugggugacgcgggagcccuacgugagcugcggccugggcaagugcuaccaguucgcccuggggcagggcaccacccucgacaaccgccacuccaacgggaccagccacgaccggacgccccaccgcacccugcugauguccgagcucggcguccccuuccaccuggccaccaagcaggucugcaucgccuggagcuccagcuccugccacgacggggaggcguggcugcacaucugcgugaccggcgacgaccggaacgccacggccagcaucaucuacggcgggaugcucguggacuccaucggcagcuggagcaagaacauccugcgcacccaggaguccgagugcgugugcaucaacgggaccugcaccguggucaugacggacggcagcgccuccggcaaggccgacacccggauccuguucauccgcgaggggaagaucgugcacaucagcccgcucuccggcagcgcgcagcacguggaggagugcuccugcuacccccaguaccccgagguccggugcgugugccgcgacaacuggcgggggagcaaccgccccgugcuguacaucaacauggccgacuacuccgucgacagcggcuacgugugcuccgggcuggugggcgacaccccgcggaacgacgacaccagcuccagcuccaacugcaaggaccccaacaacgagcgcggcgcccccggggucaagggcugggccuucgacagcgggaacgacaucuggaugggccggacgaucgagaaggaccuccgcuccggguacgagaccuuccgggugaucggcggcuggaacaccgccaacagcaagucccagaccaaccgccaggugaucgucgacagcgacaacagcuccggguacagcggcaucuucuccguggagggcaagagcugcaucaaccggugcuucuacgucgagcugauccgcgggcgccccaaggagacgcgggugugguggaccuccaacagcaucaucguguucugcgggaccuccggcaccuacggcacggggagcuggccggacggcgcgaacaucaacuucaugcccaucuga

SEQ ID NO: 84564 - RNA, 1401 nt, Artificial Sequence
  derived and/or modified sequence opt1 from neuraminidase__InfluenzaA__AGQ81770
augaaccccaaccagaagaucaucgccaucggcagcguguccaucaccaucgccaucaucugcuucaucaugcagaucgcgauccugaccacgaccaugacccuccacuuccgccagaacgagugcagcaacccguccaacaaccaggucgugcccugcgagcccaucaucaucgagcggaacaccgugcaccugaacagcacgaccaucgagaaggagaccugccccaaggucgccgaguacaagaacugguccaagccgcagugccagaucaccggguucgcccccuucagcaaggacaacuccauccgccugagcgccggcggggacaucugggugacgcgggagcccuacguguccugcagccucggcaagugcuaccaguucgcccuggggcagggcaccacccugaagaacaagcacuccaacggcaccacgcacgaccgcaucccccaccggacccuccugaugaacgagcugggggucccguuccaccucggcaccaagcaggucugcaucgcguggagcuccagcuccugccacgacgggaaggccuggcugcacaucugcgugaccggcgacgacaagaacgccacggccagcaucaucuacgacgggaugcugguggacuccaucggcagcugguccaagaacauccuccgcacccaggagagcgagugcgugugcaucaacgggaccugcgcgguggucaugaccgacgggagcgccuccggcaaggccgacacgcgggugcuguucauccgcgaggggaagaucaucaacaucagcccccuguccggcagcgcccagcacguggaggagugcuccugcuacccccgguaccccgagguccgcugcgugugccgggacaacuggaagggcagcaaccgcccggugcucuacaucaacauggccgacuacuccgucgagagcuccuacgugugcagcgggcuggugggcgacacgccccgggacgacgacuccagcuccagcuccaacugccgcgaccccaacaacgagcggggcgcgcccggcgucaaggggugggccuucgacgacggcaacgacaucuggaugggccgcaccaucaagagcgacucccggagcggguacgagaccuuccgcguggugaacggcuggaccaccgccaacuccaagagccagaucaaccggcaggucaucguggacagcgacuccuggagcggguacuccggcaucuucagcgucgaggggaagaacugcaucaaccgcugcuucuacguggagcugauccggggccgcccgcaggagacccgcgugugguggaccuccaacagcaucaucgucuucugcggcacguccgggaccuacggcaccgggagcuggcccgacggcgccaacaucaacuucaugcccaucuga

SEQ ID NO: 84565 - RNA, 1410 nt, Artificial Sequence
  derived and/or modified sequence opt1 from neuraminidase__InfluenzaA__AGQ81772
augaaccccaaccagaagaucguggccaucggcagcgccucccugaccaucgcgaccaugugccuccugcugcagaucgcccucuucgccacgaccaugacccugcacuucaagcagaccgggugcacgaacagcuccgacaaccaggccgucccgugcggccccaucaucaucgagcgcaacaucaccgagaucgugcaccugaacagcaccacccucgagaaggagacgugccccaaguccgccggguaccggaacuggagcaagccccagugccagaucaccggcuucgcgccguucuccaaggacaacagcauccgccuggccgccgccggggacaucugggugacccgggagcccuacgucuccugcggccugggcaagugcuaccaguucgcgcucgggcagggcaccacgcuggacaacaagcacagcaacgggaccacccacgaccgcacgccccaccggacccugcucauguccgagcugggcgugcccuuccaccuggccaccaagcaggucugcaucgccuggagcuccagcuccugccacgacgggaaggccuggcuccacgugugcgugaccggcgacgacaagaacgccaccgcgagcaucaucuacgacggcauccugguggacuccaucgccagcugguccaagaacauccugcgcacgcaggagagcgagugcgucugcaucaacgggaccugcaccguggugaugaccgacggcagcgccuccgggcgggccgacacgcgcauccucuucauccgggagggcaagaucguccacaucagcccgcuguccggcagcgcccagcacguggaggagugcuccugcuacccccgcuaccccgaggugcggugcgucugccgcgacaacuggaaggggagcaaccggcccgugcuguucaucaacauggcggacuacuccaucgacagcuccuacgugugcccgggccucgucggggacacgccccgcaacgacgaccggagcuccagcuccaacugccgcgaccccaacaacgagcggggcgcccccggggugaagggcugggccuucgacagcggcaacgacaucuggauggggcgcaccaucgagaaggacucccggagcggcuacgagaccuuccgcgugaucuccggguggagcaccgccaacuccaagagccagaucaaccggcaggucaucguggaccgcgacaacagcuccggcuacagcgggaucuucuccguggagggcaagagcugcaucaaccgcugcuucuacgucgagcugauccggggccgcccgaaggagaaccgggugugguggaccuccaacagcaucaucgucuucugcgggaccuccggcaccuacgggacgggcagcuggcccgacggggccaacaucaaccugaugcccaucuga

SEQ ID NO: 84566 - RNA, 1401 nt, Artificial Sequence
  derived and/or modified sequence opt1 from neuraminidase__InfluenzaA__AGQ81773
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaagaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccgcugcacuggggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacgggagcgccuccggcaaggccgacacccggguccucuucauccgcgaggggaagaucaucaacaucagcccccuguccggcagcgcccagcacguggaggagugcuccugcuacccccgguaccccgaggugcgcugcgugugccgggacaacuggaagggcagcaaccgcccggugcuguacaucaacauggccgacuacuccaucgagagcuccuacgucugcagcgggcucgugggcgacacgccccgggacgacgacuccagcuccagcuccaacugccgcgaccccaacaacgagcggggcgcgcccggcgugaagggguggggcuucgacgacggcaacgacaucuggauggggcgcaccaucaagagcgacucccggagcggcuacgagaccuuccgcgucgugaacggguggaccacggccaacuccaagagccagaucaaccgccaggugaucgucgacagcgacuccuggagcggcuacuccgggaucuucagcguggagggcaagaacugcaucaaccggugcuucuacgucgagcugauccggggccgcccgcaggagacccgcgugugguggaccuccaacagcaucaucguguucugcgggaccuccggcacguacgggaccggcagcuggcccgacggggccaacaucaacuucaugcccaucuga

SEQ ID NO: 84567 - RNA, 1401 nt, Artificial Sequence
  derived and/or modified sequence opt1 from neuraminidase__InfluenzaA__AGQ81774
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccaccgccagcaucaucuacgacggcaugcugguggacuccaucgggagcugguccaagaacauccuccggacgcaggagagcgagugcgucugcaucaacgggaccugcgcgguggugaugaccgacggcagcgccuccggcaaggccgacacccgcguccuguucauccgggagggcaagaucaucaacaucagcccccuguccgggagcgcccagcacguggaggagugcuccugcuacccccgcuaccccgaggugcggugcgucugccgcgacaacuggaagggcagcaaccggccgauccucuacaucaacauggccgacuacuccaucgagagcuccuacgugugcagcggccuggugggggacacgccccgcaacgacgacuccagcuccagcuccaacugccgggaccccaacaacgagcgcggcgcgcccggggucaagggcugggccuucgacgacgggaacgacguguggaugggccggaccaucaagaacggcagccgcuccggguacgagaccuuccggguggucaacggcuggaccaucgccaacagcaagucccagaucaaccgccaggugaucguggacagcgacgacuggagcggguacuccggcaucuucagcgucgaggggaagaagugcaucaaccggugcuucuacguggagcugauccgcggccgcccgcaggagccccgggucugguggacguccaacagcaucaucguguucugcggcaccuccgggaccuacggcaccgggagcuggcccgacggcgccaacaucaacuucaugcccaucuga

SEQ ID NO: 84568 - RNA, 1401 nt, Artificial Sequence
  derived and/or modified sequence opt1 from neuraminidase__InfluenzaA__AGQ81776
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccccaccggacgcugcucaugaacgagcugggggucccguuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacgggagcgccuccggcaaggccgacacccggguccucuucauccgcgaggggaagaucaucaacaucagcccccuguccggcagcgcccagcacguggaggagugcuccugcuacccccgguaccccgaggugcgcugcgugugccgggacaacuggaagggcagcaaccgcccggugcuguacaucaacauggccgacuacuccaucgagagcuccuacgucugcagcgggcucgugggcgacacgccccgggacgacgacuccagcuccagcuccaacugccgcgaccccaacaacgagcggggcgcgcccggcgugaaggggugggccuucgacgacggcaacgacaucuggaugggccgcaccaucaagagcgacucccggagcggguacgagaccuuccgcgucaucgacggcuggaccacggccgacuccaagagccagaucaaccgccaggugaucguggacagcgacuccuggagcggguacuccggcaucuucagcgucgaggggaagaacugcaucaaccggugcuucuacguggagcugauccggggccgcccgcaggagacccgcgucugguggaccuccaacagcaucaucguguucugcggcaccuccgggacguacggcaccgggagcuggcccgacggcgccaacaucaacuucaugcccaucuga

SEQ ID NO: 84569 - RNA, 1410 nt, Artificial Sequence
  derived and/or modified sequence opt1 from neuraminidase__InfluenzaA__AGQ81777
augaaccccaaccagaagaucgugaccaucggcagcgccucccugaccaucgccacgaugugccuccugcugcagaucgcccucuucgcgaccaccaugacccugcacuucaagcagacggggugcaccaacagcuccgacaaccaggccgucccgugcggccccaucaucaucgagcgcaacaucaccgagaucgugcaccugaacagcaccacgcucgagaaggagaccugccccaaguccgccggguaccggaacuggagcaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaacaagcacagcaacgggaccacccacgaccgcacgccccaccggacccugcucaugaacgagcugggcgugcccuuccaccuggcgaccaagcaggucugcaucgccugguccagcuccagcugccacgacgggaaggccuggcuccacgugugcgugaccggcgacgacaagaacgccacggccuccaucaucuacgacggcauccugguggacagcaucgcguccuggagcaagaacauccugcgcacccaggaguccgagugcgucugcaucaacgggaccugcaccguggugaugacggacggcagcgccagcgggcgggccgacacccgcauccucuucauccgggagggcaagaucguccacaucuccccgcugagcggcuccgcccagcacguggaggagugcagcugcuacccccgcuaccccgaggugcggugcgucugccgcgacaacuggaacggguccaaccggcccgugcuguucaucaacauggccgacuacagcaucgacuccagcuacgugugcuccggccucgucggggacaccccgcgcaacgacgaccggagcuccagcuccaacugccgcgaccccaacaacgagcggggcgcgcccggggugaagggcugggccuucgacagcggcaacgacaucuggauggggcgcaccaucgagaaggacucccggagcggcuacgagacguuccgcgugaucuccggguggagcaccgccaacuccaagagccagaucaaccggcaggucaucguggaccgcgacaacagcuccggcuacagcgggaucuucuccguggagggcaagagcugcaucaaccgcugcuucuacgucgagcugauccggggccgccccaaggagaaccgggugugguggaccuccaacagcaucaucgucuucugcgggaccuccggcacguacgggaccggcagcuggccggacggggccaacaucaaccugaugcccaucuga

SEQ ID NO: 84570 - RNA, 1410 nt, Artificial Sequence
  derived and/or modified sequence opt1 from neuraminidase__InfluenzaA__AGQ81778
augaaccccaaccagaagaucgugaccaucggcagcgccucccugaccaucgccacgaugugccuccugcugcagaucgcccucuucgcgaccaccaugacccugcacuucaagcagacggggugcaccaacagcuccgacaaccaggccgucccgugcggccccaucaucaucgagcgcaacaucaccgagaucgugcaccugaacagcaccacgcucgagaaggagaccugccccaaguccgccggguaccggaacuggagcaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaacaagcacagcaacgggaccacccacgaccgcacgccccaccggacccugcucaugaacgagcugggcgugcccuuccaccuggcgaccaagcaggucugcaucgccugguccagcuccagcugccacgacgggaaggccuggcuccacgugugcgugaccggcgacgacaagaacgccacggccuccaucaucuacgacggcauccugguggacagcaucgcguccuggagcaagaacauccugcgcacccaggaguccgagugcgucugcaucaacgggaccugcaccguggugaugacggacggcagcgccagcgggcgggccgacacccgcauccucuucauccgggagggcaagaucguccacaucuccccgcugagcggcuccgcccagcacguggaggagugcagcugcuacccccgcuaccccgaggugcggugcgucugccgcgacaacuggaagggguccaaccggcccgugcuguucaucaacauggccgacuacagcaucgacuccagcuacgugugcuccggccucgucggggacaccccgcgcaacgacgaccggagcuccagcuccaacugccgcgaccccaacaacgagcggggcgcgcccggggugaagggcugggccuucgacagcggcaacgacaucuggauggggcgcaccaucgagaaggacucccggagcggcuacgagacguuccgcgugaucuccggguggagcaccgccaacuccaagagccagaucaaccggcaggucaucguggaccgcgacaacagcuccggcuacagcgggaucuucuccguggagggcaagagcugcaucaaccgcugcuucuacgucgagcugauccggggccgccccaaggagaaccgggugugguggaccuccaacagcaucaucgucuucugcgggaccuccggcacguacgggaccggcagcuggccggacggggccaacaucaaccugaugcccaucuga

SEQ ID NO: 84571 - RNA, 1410 nt, Artificial Sequence
  derived and/or modified sequence opt1 from neuraminidase__InfluenzaA__AGQ81779
augaaccccaaccagaagaucguggccaucggcagcgccucccugaccaucgcgaccaugugccuccugcugcagaucgcccucuucgccacgaccaugacccugcacuucaagcagaccgggugcacgaacagcuccgacaaccaggccgucccgugcggccccaucaucaucgagcgcaacaucaccgagaucgugcaccugaacagcaccacccucgagaaggagacgugccccaaguccgccggguaccggaacuggagcaagccccagugccagaucaccggcuucgcgccguucuccaaggacaacagcauccgccuggccgccgccggggacaucugggugacccgggagcccuacgucuccugcggccugggcaagugcuaccaguucgcgcucgggcagggcaccacgcuggacaacaagcacagcaacgggaccacccacgaccgcacgccccaccggacccugcucaugaacgagcugggcgugcccuuccaccuggccaccaagcaggucugcaucgccugguccagcuccagcugccacgacgggaaggccuggcuccacgugugcgugaccggcgacgacaagaacgccaccgcguccaucaucuacgacggcauccugguggacagcaucgccuccuggagcaagaacauccugcgcacgcaggaguccgagugcgucugcaucaacgggaccugcaccguggugaugaccgacggcagcgccagcgggcgggccgacacgcgcauccucuucauccgggagggcaagaucguccacaucuccccgcugagcggcuccgcccagcacguggaggagugcagcugcuacccccgcuaccccgagauccggugcgugugccgcgacaacuggaagggguccaaccggcccguccuguucaucaacauggcggacuacagcaucgacuccagcuacgugugcuccggccucgugggggacaccccgcgcaacgacgaccggagcuccagcuccaacugccgcgaccccaacaacgagcggggcgcccccggggucaagggcugggccuucgacagcggcaacgacaucuggauggggcgcaccaucgagaaggacucccggagcggcuacgagaccuuccgcgugaucuccggguggagcacggccaacuccaagagccagaucaaccgccaggugaucgucgaccgggacaacagcuccggcuacagcgggaucuucuccguggagggcaagagcugcaucaaccgcugcuucuacguggagcugauccggggccgccccaaggagaaccgggucugguggaccuccaacagcaucaucguguucugcgggaccuccggcaccuacgggacgggcagcuggccggacggggccaacaucaaccugaugcccaucuga

SEQ ID NO: 84572 - RNA, 1410 nt, Artificial Sequence
  derived and/or modified sequence opt1 from neuraminidase__InfluenzaA__AGQ81780
augaaccccaaccagaagaucguggccaucggcagcgccucccugaccaucgcgaccaugugccuccugcugcagaucgcccucuucgccacgaccaugacccugcacuucaagcagaccgggugcacgaacagcuccgacaaccaggccgucccgugcggccccaucaucaucgagcgcaacaucaccgagaucgugcaccugaacagcaccacccucgagaaggagacgugccccaaguccgccggguaccggaacuggagcaagccccagugccagaucaccggcuucgcgccguucuccaaggacaacagcauccgccuggccgccgccggggacaucugggugacccgggagcccuacgucuccugcggccugggcaagugcuaccaguucgcgcucgggcagggcaccacgcuggacaacaagcacagcaacgggaccacccacgaccgcacgccccaccggacccugcucaugaacgagcugggcgugcccuuccaccuggccaccaagcaggucugcaucgccugguccagcuccagcugccacgacgggaaggccuggcuccacgugugcgugaccggcgacgacaagaacgccaccgcguccaucaucuacgacggcauccugguggacagcaucgccuccuggagcaagaacauccugcgcacgcaggaguccgagugcgucugcaucaacgggaccugcaccguggugaugaccgacggcagcgccagcgggcgggccgacacgcgcauccucuucauccgggagggcaagaucguccacaucuccccgcugagcggcuccgcccagcacguggaggagugcagcugcuacccccgcuaccccgaggugcggugcgucugccgcgacaacuggaagggguccaaccggcccgugcuguucaucaacauggcggacuacagcaucgacuccagcuacgugugcuccggccucgucggggacaccccgcgcaacgacgaccggagcuccagcuccaacugccgcgaccccaacaacgagcggggcgccagcggggugaagggcugggccuucgacuccggcaacgacaucuggauggggcgcaccaucgagaaggacagccgguccggcuacgagaccuuccgcgugaucagcgggugguccacggccaacagcaagagccagaucaaccggcaggucaucguggaccgcgacaacuccagcggcuacuccgggaucuucagcguggagggcaaguccugcaucaaccgcugcuucuacgucgagcugauccggggccgccccaaggagaaccgggugugguggaccagcaacuccaucaucgucuucugcgggaccagcggcaccuacgggacgggcuccuggcccgacggggccaacaucaaccugaugccgaucuga

SEQ ID NO: 84573 - RNA, 1401 nt, Artificial Sequence
  derived and/or modified sequence opt1 from neuraminidase__InfluenzaA__AGQ81781
augaaccccaaccagaagaucaucgccaucggcagcgugucccugaccaucgccaucaucugcuuccucaugcagaucgcgauccugaccacgaccaugaccccgcacuuccgccagaacgagugcagcaaccccuccaacaaccaggucgugcccugcgagcccaucaucaucgagcggaacaccgugcaccugaacagcacgaccaucgagaaggagaucugcccgaaggucgccgaguacaagaacugguccaagccccagugccagaucaccggguucgcccccuucagcaaggacaacuccauccgccucagcgccggcggggacaucugggugacccgggagcccuacguguccugcagccugggcaagugcuaccaguucgcccuggggcagggcacgacccucaagaacaagcacuccaacggcaccacccacgaccgcaucccgcaccggacgcugcugaugaacgagcucgggguccccuuccaccugggcaccaagcaggucugcaucgcguggagcuccagcuccugccacgacgggaaggccuggcugcacaucugcgugaccggcgacgacaagaacgccaccgccagcaucaucuacgacgggaugcucguggacuccaucggcagcugguccaagaacauccugcgcacgcaggagagcgagugcgugugcaucaacgggaccugcgcgguggucaugaccgacgggagcgccuccggcaaggccgacacccggauccuguucauccgcgaggggaagaucaucaacaucagcccccucuccggcagcgcccagcacguggaggagugcuccugcuacccccgguacccggaggugcgcugcgucugccgggacaacuggaagggcagcaaccgccccgugcuguacaucaacauggccgacuacuccaucgagagcuccuacgugugcagcgggcuggucggcgacacgccccgggacgacgacuccagcuccagcuccaacugccgcgaccccaacaacgagcggggcgcgccgggcgugaaggggugggccuucgacgacggcaacgacaucuggaugggccgcaccaucaagagcgacucccggagcggguacgagaccuuccgcguggucaacggcuggaccacggccaacuccaagagccagaucaaccgccaggugaucguggacagcgacuccuggagcggguacuccggcaucuucagcgucgaggggaagaacugcaucaaccggugcuucuacguggagcucauccggggccgcccccaggagacccgcgucugguggaccuccaacagcaucaucguguucugcggcaccuccgggacguacggcaccgggagcuggcccgacggcgccgacaucaaccugaugcccaucuga

SEQ ID NO: 84574 - RNA, 1410 nt, Artificial Sequence
  derived and/or modified sequence opt1 from neuraminidase__InfluenzaA__AGQ81783
augaaccccaaccagaagaucgugaccaucggcagcgccucccugaccaucgccacgaugugccuccugcugcagaucgcccucuucgcgaccaccaugacccugcacuucaagcagacggggugcaccaacagcuccgacaaccaggccgucccgugcggccccaucaucaucgagcgcaacaucaccgagaucgugcaccugaacagcaccacgcucgagaaggagaccugccccaaguccgccggguaccggaacuggagcaagccccagugccagaucaccggcuucgccccguucuccaaggacaacagcauccgccuggcggccgccggggacaucugggugacccgggagcccuacgucuccugcggccugggcaagugcuaccaguucgcccucgggcagggcacgacccuggacaacaagcacagcaacgggaccacccacgaccgcacgccccaccggacccugcucaugaacgagcugggcgugcccuuccaccuggcgaccaagcaggucugcaucgccugguccagcuccagcugccacgacgggaaggccuggcuccacgugugcgugaccggcgacgacaagaacgccacggccuccaucaucuacaacggcauccugguggacagcaucgcguccuggagcaagaacauccugcgcacccaggaguccgagugcgucugcaucaacgggaccugcaccguggugaugacggacggcagcgccagcgggcgggccgacacccgcauccucuucauccgggagggcaagaucguccacaucuccccgcugagcggcuccgcccagcacguggaggagugcagcugcuacccccgcuaccccgaggugcggugcgucugccgcgacaacuggaagggguccaaccggcccgugcuguucaucaacauggccgacuacagcaucgacuccagcuacgugugcuccggccucgucggggacaccccgcgcaacgacgaccggagcuccagcuccaacugccgcgaccccaacaacgagcggggcgcgcccggggugaagggcugggccuucgacagcggcaacgacaucuggauggggcgcaccaucgagaaggacucccggagcggcuacgagacguuccgcgugaucuccggguggagcaccgccaacuccaagagccagaucaaccggcaggucaucguggaccgcgacaacagcuccggcuacagcgggaucuucuccguggagggcaagagcugcaucaaccgcugcuucuacgucgagcugauccggggccgccccaaggagaaccgggugugguggaccuccaacagcaucaucgucuucugcgggaccuccggcacguacgggaccggcagcuggccggacggggccaacaucaaccugaugcccaucuga

SEQ ID NO: 84575 - RNA, 1401 nt, Artificial Sequence
  derived and/or modified sequence opt1 from neuraminidase__InfluenzaA__AGQ81784
augaaccccaaccagaagaucaucgccaucggcagcgugucccugaccaucgccaucaucugcuuccucaugcagaucgcgauccugaccacgaccaugacccugcacuuccgccagaacgagugcagcaacccguccaacaaccaggucgugcccugcgagcccaucaucaucgagcggaacaccgugcaccucaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugcgcaacaagcacuccaacggcaccacccacgaccggaucccccaccgcacgcugcucaugaacgagcugggggucccguuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcggacgcaggagagcgagugcgugugcaucaacgggaccugcgcgguggucaugaccgacggcaacgccagcggcaaggccgacacccgcguccucuucauccgggaggggaagaucaucaacaucagcccccuguccggcuccgcccagcacguggaggagugcagcugcuacccccgcuaccccgaggugcggugcgugugccgcgacaacuggaagggcuccaaccggccggugcuguacaucaacauggccgacuacagcaucgaguccagcuacgucugcuccgggcucgugggcgacacgccccgcgacgacgacagcuccagcuccagcaacugccgggaccccaacaacgagcgcggggcgcccggcgugaaggggugggccuucgacgacggcaacgacaucuggaugggccggaccaucaaguccgacagccgcuccggguacgagaccuuccgggucgugaacggcuggaccacggccaacagcaagucccagaucaaccgccaggugaucgucgacagcgacagcugguccggguacagcggcaucuucuccguggaggggaagaacugcaucaaccggugcuucuacgucgagcugauccgcggccgcccgcaggagacccgggugugguggaccagcaacuccaucaucguguucugcggcaccagcgggacguacggcaccggguccuggcccgacggcgccgacaucaacuucaugcccaucuga

SEQ ID NO: 84576 - RNA, 1401 nt, Artificial Sequence
  derived and/or modified sequence opt1 from neuraminidase__InfluenzaA__AGQ81785
augaaccccaaccagaagaucaucgccaucggcagcgugucccugaccaucgccaucaucugcuucaucaugcagaucgcgauccucaccacgaccaugaccccgcacuuccgccagaacgagugcagcaaccccuccaacaaccaggucgugcccugcgagcccaucaucaucgagcggaacaccgugcaccugaacagcacgaccaucgagaaggagaucugcccgaaggucgccgaguacaagaacugguccaagccccagugccagaucaccggguucgcccccuucagcaaggacaacuccauccgccugagcgccggcggggacaucugggugacccgggagcccuacguguccugcagccucggcaagugcuaccaguucgcccuggggcagggcacgacccugaagaacaagcacuccaacggcaccacccacgaccgcaucccgcaccggacgcuccugaugaacgagcuggggguccccuuccaccucggcaccaagcaggucugcaucgcguggagcuccagcuccugccacgacgggaaggccuggcugcacaucugcgugaccggcgacgacaagaacgccaccgccagcaucaucuacgacgggaugcugguggacuccaucggcagcugguccaagaacauccuccgcacgcaggagagcgagugcgugugcaucaacgggaccugcgcgguggucaugaccgacgggagcgccuccggcaaggccgacacccggauccuguucauccgcgaggggaagaucaucaacaucagcccccuguccggcagcgcccagcacguggaggagugcuccugcuacccccgguacccggaggugcgcugcgucugccgggacaacuggaagggcagcaaccgccccgugcucuacaucaacauggccgacuacuccaucgagagcuccuacgugugcagcgggcuggucggcgacacgccccgggacgacgacuccagcuccagcuccaacugccgcgaccccaacaacgagcggggcgcgccgggcgugaaggggugggccuucgacgacggcaacgacaucuggaugggccgcaccaucaagagcgacucccggagcggguacgagaccuuccgcguggucaacggcuggaccacggccaacuccaagagccagaucaaccgccaggugaucguggacagcgacuccuggagcggguacuccggcaucuucagcgucgaggggaagaacugcaucaaccggugcuucuacguggagcugauccggggccgcccccaggagacccgcgucugguggaccuccaacagcaucaucguguucugcggcaccuccgggacguacggcaccgggagcuggcccgacggcgccgacaucaaccucaugcccaucuga

SEQ ID NO: 84577 - RNA, 1401 nt, Artificial Sequence
  derived and/or modified sequence opt1 from neuraminidase__InfluenzaA__AGQ81787
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucgugcccugcgagcccaucaucaucgagcggaacaccgugcaccugaacagcaccacgaucgagcgcgagaucugccccaaggucgccgaguacaagaacugguccaagccgcagugccagaucaccggguucgcccccuucagcaaggacaacuccauccggcugagcgccggcggggacaucugggugacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgucccguuccaccucgggaccaagcaggucugcaucgcguggagcuccagcuccugcuacgacggcaaggccuggcugcacaucugcgugaccggggacgacaagaacgccaccgccagcaucaucuacgacggcaugcugguggacuccaucgggagcugguccaagaacauccuccggacgcaggagagcgagugcgugugcaucaacgggaccugcgcgguggucaugaccgacggcagcgccuccggcaaggccgacacccgcgugcuguucauccgggagggcaagaucaucaacaucagcccccuguccgggagcgcccagcacguggaggagugcuccugcuacccccgcuaccccgagguccggugcgugugccgcgacaacuggaagggcagcaaccggccgauccucuacaucaacauggccgacuacuccaucgagagcuccuacgugugcagcggccuggucggggacacgccccgcaacgacgacuccagcuccagcuccaacugccgggaccccaacaacgagcgcggcgcgcccggggugaagggcugggccuucgacgacgggaacgacguguggaugggccggaccaucaagaacggcagccgcuccggguacgagaccuuccgggucgugaacggcuggaccauggccaacagcaagucccagaucaaccgccaggugaucgucgacagcgacgacuggagcggguacuccggcaucuucagcguggaggggaagaagugcaucaaccggugcuucuacgucgagcugauccgcggccgcccgcaggagccccgggugugguggacguccaacagcaucaucguguucugcggcaccuccgggaccuacggcaccgggagcuggcccgacggcgccaacaucaacuucaugcccaucuga

SEQ ID NO: 84578 - RNA, 1401 nt, Artificial Sequence
  derived and/or modified sequence opt1 from neuraminidase__InfluenzaA__AGQ81789
augaaccccaaccagaagaucaucgccaucggcagcgugucccugaccaucgccaucaucugccuccugaugcagaucgcgauccugaccacgaccaugaccccgcacuuccgccagaacgagugcagcaaccccuccaacaaccaggucgugcccugcgagcccaucaucaucgagcggaacaccgugcaccucaacagcacgaccaucgagaaggagaucugcccgaaggucgccgaguacaagaacugguccaagccccagugccagaucaccggguucgcccccuucagcaaggacaacuccauccgccugagcgccggcggggacaucugggugacccgggagcccuacguguccugcagccugggcaagugcuaccaguucgcccucgggcagggcacgacccugaagaacaagcacuccaacggcaccacccacgaccgcaucccgcaccggacgcugcucaugaacgagcuggggguccccuuccaccugggcaccaagcaggucugcaucgcguggagcuccagcuccugccacgacgggaaggccuggcuccacaucugcgugaccggcgacgacaagaacgccaccgccagcaucaucuacgacgggaugcugguggacuccaucggcagcugguccaagaacauccugcgcacgcaggagagcgagugcgugugcaucaacgggaccugcgcgguggucaugaccgacgggagcgccuccggcaaggccgacacccggauccucuucauccgcgaggggaagaucaucaacaucagcccccuguccggcagcgcccagcacguggaggagugcuccugcuacccccgguacccggaggugcgcugcgucugccgggacaacuggaagggcagcaaccgccccgugcuguacaucaacauggccgacuacuccaucgagagcuccuacgugugcagcgggcucgucggcgacacgccccgggacgacgacuccagcuccagcuccaacugccgcgaccccaacaacgagcggggcgcgccgggcgugaaggggugggccuucgacgacggcaacgacaucuggaugggccgcaccaucaagagcgacucccggagcggguacgagaccuuccgcguggucaacggcuggaccacggccaacuccaagagccagaucaaccgccaggugaucguggacagcgacuccuggagcggguacuccggcaucuucagcgucgaggggaagaacugcaucaaccggugcuucuacguggagcugauccggggccgcccccaggagacccgcgucugguggaccuccaacagcaucaucguguucugcggcaccuccgggacguacggcaccgggagcuggcccgacggcgccgacaucaaccugaugcccaucuga

SEQ ID NO: 84579 - RNA, 1401 nt, Artificial Sequence
  derived and/or modified sequence opt1 from neuraminidase__InfluenzaA__AGQ81790
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggccaugcccugcgagcccaucaucaucgagcggaacaccguccaccugaacagcaccacgaucgagcgcgagaucugccccaaggugaccgaguacaagaacugguccaagccgcagugccagaucaccggguucgcccccuucagcaaggacaacuccauccggcugagcgccggcggggacaucugggugacccgcgagcccuacgucuccugcagccucgacaagugcuaccaguucgcccugggccaggggacgacccugaagaacaagcacuccaacggcaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccacggccagcaucaucuacgacggcaugcugguggacuccaucgggagcugguccaagaacauccuccggacccaggagagcgagugcgugugcaucaacgggaccugcgcggucgugaugaccgacggcagcgccuccggccgcgccgacacgcgggugcuguucauccgcgagggcaagaucaucaacaucagcccccuguccgggaacgcccagcacgucgaggagugcagcugcuacccccgguaccccgaggugcgcugcgugugccgggacaacuggaagggcuccaaccgcccgauccucuacaucaacauggccgacuacagcaucgaguccagcuacgucugcuccggccuggugggggacacgccccggaacgacgacagcuccagcuccagcaacugccgcgaccccaacaacgagcggggcgcgcccggggugaagggcugggccuucgacgacgggaacgacgucuggaugggccgcaccaucaagaacggcucccggagcggguacgagaccuuccgcguggugaacggcuggaccauggccaacuccaagagccagaucaaccggcaggucaucguggacuccgacgaguggagcggguacagcggcaucuucuccguggaggggaagaagugcaucaaccgcugcuucuacgucgagcugauccgcggccggccgcaggagccccgcgugugguggaccagcaacuccaucaucgucuucugcggcaccagcgggaccuacggcacgggguccuggcccgacggcgccaacaucaacuucaugcccaucuga

SEQ ID NO: 84580 - RNA, 1401 nt, Artificial Sequence
  derived and/or modified sequence opt1 from neuraminidase__InfluenzaA__AGQ81792
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccucaacaagugcuaccaguucgcccugggccaggggaccacgcuggagaacaagcacuccaacggcaccacccacgaccggacgccccaccgcacccuccugaugaacgagcugggcgugccguuccaccucgggaccaagcaggucugcauggcguggagcuccagcuccugcuacgacggcaaggccuggcugcacaucugcgugaccggggacgacaagaacgccaccgccagcgugaucuacgacggcaugcuggucgacuccaucgggagcuggucccagaacauccuccggacgcaggagagcgagugcgugugcaucaacgggaccugcgcgguggucaugaccgacggcagcgccuccggcaaggccgacacccgcgugcuguucauccgggagggcaagaucaucaacaucagcccccuguccgggagcgcccagcacguggaggagugcuccugcuacccccgcuaccccgagguccggugcgugugccgcgacaacuggaagggcagcaaccggccgauccucuacaucaacauggccgacuacuccaucgagagcuccuacgugugcagcggccuggucggggacacgccccgcaacgacgacuccagcuccagcuccaacugccgggaccccaacaacgagcgcggcgcgcccggggugaagggcugggccuucgacgacgggaacgacguguggaugggccggaccaucaagaacggcagccgcuccggguacgagaccuuccgggucgugaacggcuggaccauggccaacagcaagucccagaucaaccgccaggugaucgucgacagcgacgacuggagcggguacuccggcaucuucagcguggaggggaagaagugcaucaaccggugcuucuacgucgagcugauccgcggccgcccgcaggagccccgggugugguggacguccaacagcaucaucguguucugcggcaccuccgggaccuacggcaccgggagcuggcccgacggcgccaacaucaacuucaugcccaucuga

SEQ ID NO: 84581 - RNA, 1401 nt, Artificial Sequence
  derived and/or modified sequence opt1 from neuraminidase__InfluenzaA__AGQ81793
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccucaacaagugcuaccaguucgcccugggccaggggaccacgcuggagaacaagcacuccaacggcaccacccacgaccggacgccccaccgcacccuccugaugaacgagcugggcgugccguuccaccucgggaccaagcaggucugcauggcguggagcuccagcuccugcuacgacggcaaggccuggcugcacaucugcgugaccggggacgacaagaacgccaccgccagcgugaucuacgacggcaugcuggucgacuccaucgggagcugguccaagaacauccuccggacgcaggagagcgagugcgugugcaucaacgggaccugcgcgguggucaugaccgacggcagcgccuccggcaaggccgacacccgcgugcuguucauccgggagggcaagaucaucaacaucagcccccuguccgggagcgcccagcacguggaggagugcuccugcuacccccgcuaccccgagguccggugcgugugccgcgacaacuggaagggcagcaaccggccgauccucuacaucaacauggccgacuacuccaucgagagcuccuacgugugcagcggccuggucggggacacgccccgcaacgacgacuccagcuccagcuccaacugccgggaccccaacaacgagcgcggcgcgcccggggugaagggcugggccuucgacgacgggaacgacguguggaugggccggaccaucaagaacggcagccgcuccggguacgagaccuuccgggucgugaacggcuggaccauggccaacagcaagucccagaucaaccgccaggugaucgucgacagcgacgacuggagcggguacuccggcaucuucagcguggaggggaagaagugcaucaaccggugcuucuacgucgagcugauccgcggccgcccgcaggagccccgggugugguggacguccaacagcaucaucguguucugcggcaccuccgggaccuacggcaccgggagcuggcccgacggcgccaacaucaacuucaugcccaucuga

SEQ ID NO: 84582 - RNA, 1401 nt, Artificial Sequence; identical to SEQ ID NO: 84581
  derived and/or modified sequence opt1 from neuraminidase__InfluenzaA__AGQ81794

SEQ ID NO: 84583 - RNA, 1401 nt, Artificial Sequence
  derived and/or modified sequence opt1 from neuraminidase__InfluenzaA__AGQ81795
augaaccccaaccagaagaucaucgccaucggcagcgugucccugaucaucgccaucaucugccuccugaugcagaucgcgauccugaccaccacgaugacccuccacuuccgccagaacgagugcaacaacccgagcaacaaccaggucaugcccugcgagcccaucaucaucgagcggaacaccgugcaccugaacuccaccacgaucgagcgcgagaucugccccaagguggccgaguacaagaacuggagcaagccgcagugccagaucaccggguucgcccccuucuccaaggacaacagcauccggcuguccgccggcggggacaucugggucacccgcgagcccuacgugagcugcucccucgacaagugcuaccaguucgcccugggccaggggaccacgcugaagaacaagcacagcaacggcaccacccacgaccggacgccccaccgcacccuccugaugaacgagcugggcgugccguuccaccucgggaccaagcaggucugcaucgcgugguccagcuccagcugcuacgacggcaaggccuggcugcacaucugcgugaccggggacgacaagaacgccaccgccuccaucaucuacgacggcaugcugguggacagcaucggguccuggagcaagaacauccuccggacgcaggaguccgagugcgucugcaucaacgggaccugcgcgguggugaugaccgacggcagcgccagcggcaaggccgacacccgcguccuguucauccgggagggcaagaucaucaacaucagcccccuguccggguccgcccagcacguggaggagugcagcugcuacccccgcuaccccgaggugcggugcgucugccgcgacaacuggaagggcuccaaccggccgauccucuacaucaacauggccgacuacagcaucgaguccagcuacgugugcuccggccuggugggggacacgccccgcaacgacgacagcuccagcuccagcaacugccgggaccccaacaacgagcgcggcgcgcccggggucaagggcugggccuucgacgacgggaacgacguguggaugggccggaccaucaagaacggcucccgcagcggguacgagaccuuccggguggucaacggcuggaccaucgccaacuccaagagccagaucaaccgccagaucaucguggacuccgacgacuggagcggguacagcggcaucuucuccguggaggggaagaagugcaucaaccggugcuucuacgucgagcugauccgcggccgcccgcaggagccccgggugugguggacgagcaacuccaucaucgucuucugcggcaccagcgggaccuacggcaccggguccuggcccgacggcgccaacaucaacuucaugcccaucuga

SEQ ID NO: 84584 - RNA, 1401 nt, Artificial Sequence
  derived and/or modified sequence opt1 from neuraminidase__InfluenzaA__AGQ81796
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccaccgccagcaucaucuacgacggcaugcugguggacuccaucgggagcugguccaagaacauccuccggacgcaggagagcgagugcgucugcaucaacgggaccugcgcgguggugaugaccgacggcagcgccuccggcaaggccgacacccgcguccuguucauccgggagggcaagaucaucaacaucagcccccuguccgggagcgcccagcacguggaggagugcuccugcuacccccgcuaccccgaggugcggugcgucugccgcgacaacuggaagggcagcaaccggccgauccucuacaucaacauggccgacuacuccaucgagagcuccuacgugugcagcggccuggugggggacacgccccgcaacgacgacuccagcuccagcuccaacugccgggaccccaacaacgagcgcggcgcgcccggggucaagggcugggccuucgacgacgggaacgacaucuggaugggccggaccaucaagaacggcagccgcuccggguacgagaccuuccggguggugaacggcuggaccauggccaacagcaagucccagaucaaccgccaggucaucguggacagcgacgacuggagcggguacuccggcaucuucagcguggaggggaagaagugcaucaaccggugcuucuacgucgagcugauccgcggccgcccgcaggagccccgggugugguggacguccaacagcaucaucgucuucugcggcaccuccgggaccuacggcaccgggagcuggcccgacggcgccaacaucaacuucaugcccaucuga

SEQ ID NO: 84585 - RNA, 1401 nt, Artificial Sequence
  derived and/or modified sequence opt1 from neuraminidase__InfluenzaA__AGQ81798
augaaccccaaccagaagaucaucagcaucggcuccgugagccugaucaucgccaucaucugccuccugaugcagaucgccauccugaccaccacgaugacccuccacuuccgccagaacgagugcuccaacccgagcaacaaccaggucaugcccugcgagcccaucaucaucgagcggaacaccgugcaccugaacuccaccacgaucgagcgcgagaucugccccaagguggcggaguacaagaacuggagcaagccgcagugccagaucaccggguucgcccccuucuccaaggacaacagcauccggcuguccgccggcggggacaucugggucacccgcgagcccuacgugagcugcucccucgacaagugcuaccaguucgcccugggccaggggaccacgcugaagaacaagcacagcaacggcaccacccacgaccggacgccccaccgcacccuccugaugaacgagcugggcgugccguuccaccucgggaccaagcaggucugcaucgccugguccagcuccagcugcuacgacggcaaggcguggcugcacaucugcgugaccggggacgacaagaacgccaccgccuccaucaucuacgacggcaugcugguggacagcaucggguccuggagcaagaacauccuccggacgcaggagagcgagugcgucugcaucaacgggaccugcgccguggugaugaccgacggcuccgcgagcggcaaggccgacacccgcguccuguucauccgggagggcaagaucaucaacaucagcccccuguccggguccgcccagcacguggaggagugcagcugcuacccccgcuaccccgaggugcggugcgucugccgcgacaacuggaagggcuccaaccggccgauccucuacaucaacauggccgacuacagcaucgaguccagcuacgugugcuccggccuggugggggacacgccccgcaacgacgacagcuccagcuccagcaacugccgggaccccaacaacgagcgcggcgcccccggggucaagggcugggcguucgacgacgggaacgacguguggaugggccggaccaucaagaacggcucccgcagcggguacgagaccuuccggguggucaacggcuggaccauggccaacuccaagagccagaucaaccgccaggugaucguggacagcgacgacugguccggguacagcggcaucuucuccgucgaggggaagaagugcaucaaccggugcuucuacguggagcugauccgcggccgcccgcaggagccccgggucugguggacgagcaacuccaucaucguguucugcggcaccagcgggaccuacggcaccggguccuggcccgacggcgccaacaucaacuucaugcccaucuga

SEQ ID NO: 84586 - RNA, 1401 nt, Artificial Sequence
  derived and/or modified sequence opt1 from neuraminidase__InfluenzaA__AGQ81799
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccucgacaagugcuaccaguucgcccugggccaggggaccacgcugaagaacaagcacuccaacggcaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccaccgccagcaucaucuacgacggcaugcugguggacuccaucgggagcugguccaagaacauccuccggacgcaggagagcgagugcgucugcaucaacgggaccugcgcgguggugaugaccgacggcagcgccuccggcaaggccgacacccgcguccuguucauccgggagggcaagaucaucaacaucagcccccuguccgggagcgcccagcacguggaggagugcuccugcuacccccgcuaccccgaggugcggugcgucugccgcgacaacuggaagggcagcaaccggccgauccucuacaucaacauggccgacuacuccaucgagagcuccuacgugugcagcggccuggugggggacacgccccgcaacgacgacuccagcuccagcuccaacugccgggaccccaacaacgagcgcggcgcgcccggggucaagggcugggccuucgacgacgggaacgacguguggaugggccggaccaucaagaacggcagccgcuccggguacgagaccuuccggguggucaacggcuggaccauggccaacagcaagucccagaucaaccgccaggugaucguggacagcgacgacuggagcggguacuccggcaucuucagcgucgaggggaagaagugcaucaaccggugcuucuacguggagcugauccgcggccgcccgcaggagccccgggucugguggacguccaacagcaucaucguguucugcggcaccuccgggaccuacggcaccgggagcuggcccgacggcgccaacaucaacuucaugcccaucuga

SEQ ID NO: 84587 - RNA, 1401 nt, Artificial Sequence; identical to SEQ ID NO: 84586
  derived and/or modified sequence opt1 from neuraminidase__InfluenzaA__AGQ81800

SEQ ID NO: 84588 - RNA, 1401 nt, Artificial Sequence
  derived and/or modified sequence opt1 from neuraminidase__InfluenzaA__AGQ81801
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccuccggcgacaucugggucacccgcgagcccuacgugagcugcucccucgacaagugcuaccaguucgcccuggggcagggcaccacgcugaagaacaagcacagcaacgggaccacccacgaccggacgccccaccgcacccuccugaugaacgagcugggcgugccguuccaccucggcaccaagcaggucugcaucgcgugguccagcuccagcugcuacgacgggaaggccuggcugcacaucugcgugaccggcgacgacaagaacgccaccgccuccaucaucuacgacgggaugcugguggacagcaucggcuccuggagcaagaacauccuccggacgcaggagagcgagugcgucugcaucaacgggaccugcgcgguggugaugaccgacggcuccgccagcggcaaggccgacacccgcguccuguucauccgggaggggaagaucaucaacaucagcccccuguccggcuccgcccagcacguggaggagugcagcugcuacccccgcuaccccgaggugcggugcgucugccgcgacaacuggaagggguccaaccggccgauccucuacaucaacauggccgacuacagcaucgaguccagcuacgugugcuccggccuggugggcgacacgccccgcaacgacgacagcuccagcuccagcaacugccgggaccccaacaacgagcgcggggcgcccggcgucaaggggugggccuucgacgacggcaacgacguguggauggggcggaccaucaagaacggcucccgcagcggcuacgagaccuuccggguggucaacggguggaccauggccaacuccaagagccagaucaaccgccaggugaucguggacagcgacgacugguccggcuacagcgggaucuucuccgucgagggcaagaagugcaucaaccggugcuucuacguggagcugauccgcgggcgcccgcaggagccccgggucugguggacgagcaacuccaucaucguguucugcggcaccagcggcaccuacgggaccggcuccuggcccgacggggccaacaucaacuucaugcccaucuga

SEQ ID NO: 84589 - RNA, 1401 nt, Artificial Sequence
  derived and/or modified sequence opt1 from neuraminidase__InfluenzaA__AGQ81802
augaaccccaaccagaagaucaucgccaucggcagcgugucccugaucaucgccaucaucugccuccugaugcagaucgcgcugcucaccaccacgaugacccugcacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcucagcgccggcggggacaucugggucacccgcgagcccuacguguccugcagccuggacaagugcuaccaguucgcccugggccaggggaccacgcucaagaacaagcacuccaacggcaccacccacgaccggacgccccaccgcacccugcugaugaacgagcucggcgugccguuccaccuggggaccaagcaggucugcaucgcguggagcuccagcuccugcuacgacggcaaggccuggcugcacaucugcgugaccggggacgacaagaacgccaccgccagcaucaucuacaacggcaugcucguggacuccaucgggagcugguccaagaacauccugcggacgcaggagagcgagugcgucugcaucaacgggaccugcgcgguggugaugaccgacggcagcgccuccggcaaggccgacacccgcguccuguucauccgggagggcgagaucaucaacaucagcccccucuccgggagcgcccagcacguggaggagugcuccugcuacccccgcuaccccgaggugcggugcgucugccgcgacaacuggaagggcagcaaccggccgauccuguacaucaacauggccgacuacuccaucgagagcuccuacgugugcagcggccuggugggggacacgccccgcaacgacgacuccagcuccagcuccaacugccgggaccccaacaacgagcgcggcgcgcccggggucaagggcugggccuucgacgacgggaacgacguguggaugggccggaccaucaagaacggcagccgcuccggguacgagaccuuccggguggucaacggcuggaccauggccaacagcaagucccagaucaaccgccaggugaucguggacagcgacgacuggagcggguacuccggcaucuucagcgucgaggggaagaagugcaucaaccggugcuucuacguggagcucauccgcggccgcccgcaggagccccgggucugguggacguccaacagcaucaucguguucugcggcaccuccgggaccuacggcaccgggagcuggcccgacggcgccaacaucaacuucaugcccaucuga

SEQ ID NO: 84590 - RNA, 1401 nt, Artificial Sequence
  derived and/or modified sequence opt1 from neuraminidase__InfluenzaA__AGQ81803
augaaccccaaccagaagaucaucgccaucggcagcgugucccugaucaucgccaucaucugccuccugaugcagaucgcgauccugaccaccacgaugacccuccacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcugagcgccuccggcgacaucugggucacccgcgagcccuacgugagcugcucccucgacaagugcuaccaguucgcccuggggcagggcaccacgcugaagaacgagcacagcaacgggaccacccacgaccggacgccccaccgcacccuccugaugaacgagcugggcgugccguuccaccucggcaccaagcaggucugcaucgcgugguccagcuccagcugcuacgacgggaaggccuggcugcacaucugcgugaccggcgacgacaagaacgccaccgccuccaucaucuacgacgggaugcugguggacagcaucggcuccuggagcaagaacauccuccggacgcaggagagcgagugcgucugcaucaacgggaccugcgcgguggugaugaccgacggcuccgccagcggcaaggccgacacccgcguccuguucauccgggaggggaagaucaucaacaucagcccccuguccggcuccgcccagcacguggaggagugcagcugcuacccccgcuaccccgaggugcggugcgucugccgcgacaacuggaagggguccaaccggccgauccucuacaucaacauggccgacuacagcaucgaguccagcuacgugugcuccggccuggugggcgacacgccccgcaacgacgacagcuccagcuccagcaacugccgggaccccaacaacgagcgcggggcgcccggcgucaaggggugggccuucgacgacggcaacgacguguggauggggcggaccaucaagaacggcucccgcagcggcuacgagaccuuccggguggucaacggguggaucauggccaacuccaagagccagaucaaccgccaggugaucguggacagcgacgacugguccggcuacagcgggaucuucuccgucgagggcaagaagugcaucaaccggugcuucuacguggagcugauccgcgggcgcccgcaggagccccgggucugguggaccagcaacuccaucaucguguucugcggcacgagcggcaccuacgggaccggcuccuggcccgacggggccaacaucaacuucaugcccaucuga

SEQ ID NO: 84591 - RNA, 1410 nt, Artificial Sequence
  derived and/or modified sequence opt1 from neuraminidase__InfluenzaA__AGQ81804
augaaccccaaccagaagaugaucgccaucggcgccgugagccugaccaucgcgaucaucugccuccugaugcagaccgccauccuggucacgaccaugacccuccacuucaagcacaacgagugcaccaacuccagcaacaaccaggccgccccgugcgggcccaucaucaucgagcgcaacgugacggaggugguccaccugaacuccaccacccuggagaaggagaucugccccaaggccgcgggcuaccggaacuggagcaagccccagugccagaucaccggguucgccccguucuccaaggacaacagcauccgccucuccgccggcggggacaucugggugacgcgggagcccuacgugagcugcggccugggcaagugcuaccaguucgcccuggggcagggcaccacccucgacaacucccacagcaacgggaccucccacgaccgcacgccccaccggacccugcugaugaacgagcucggcguccccuuccaccugaugaccaagcaggucugcaucgcguggagcuccagcuccugccacgacgggaaggccuggcugcacgugugcgugaccggcgacgaccgcaacgccacggccagcaucaucuacggcgggauccucguggacuccaucggcagcugguccaagaacauccugcggacccaggagagcgagugcgugugcaucaacgggaccugcgccgucgugaugaccgacggcagcgcguccggcaaggccgacacgcgcauccuguucauccgggaggggaagaucgugcacaucagcccgcucuccggcagcgcccagcacgucgaggagugcuccugcuacccccaguaccccgaggugcgcugcgugugccgggacaacuggcgcgggagcaaccggcccguccuguacaucaacauggccgacuacuccaucgacagcggcuacgugugcuccgggcuggugggcgacaccccgcgcaacgacgacgucagcuccagcuccaacugcaaggaccccaacaacgagcggggcgcccccggggugaagggcugggcguucgacaacgggaacgacaucuggaugggccgcaccaucgacaaggacagccgguccggguacgagaccuuccgcgugaucgacggcuggaacacggccaacagcaagucccagaccagccggcaggucaucgugggcuccgacaacagcagcggguacuccggcaucuucagcgucgaggggaaguccugcaucaaccgcugcuucuacguggagcucauccggggccgccccaaggagacccgcgugugguggaccagcaacuccaucaucgucuucugcgggacgagcggcaccuacggcaccggguccuggccggacggcgccaacaucaacuucaugcccaucuga

SEQ ID NO: 84592 - RNA, 1401 nt, Artificial Sequence
  derived and/or modified sequence opt1 from neuraminidase__InfluenzaA__AGQ81805
augaaccccaaccagaagaucaucgccaucggcagcgugucccugaucaucgccaucaucugccuccugaugcagaucgcgcugcucaccaccacgaugacccugcacuuccgccagaacgagugcagcaacccguccaacaaccaggucaugcccugcgagcccaucaucaucgagcggaacaccgugcaccugaacagcaccacgaucgagcgcgagaucugccccaagguggccgaguacaagaacugguccaagccgcagugccagaucaccggguucgcccccuucagcaaggacaacuccauccggcucagcgccggcggggacaucugggucacccgcgagcccuacguguccugcagccuggacaagugcuaccaguucgcccugggccaggggaccacgaugaagaacaagcacuccaacggcaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccaccgccagcaucaucuacgacggcaugcugguggacuccaucgggagcugguccaagaacauccuccggacgcaggagagcgagugcgucugcaucaacgggaccugcgcgguggugaugaccgacggcagcgccuccggcaaggccgacacccgcguccuguucauccgggagggcaagaucaucaacaucagcccccuguccgggagcgcccagcacguggaggagugcuccugcuacccccgcuaccccgaggugcggugcgucugccgcgacaacuggaagggcagcaaccggccgauccucuacaucaacauggccgacuacuccaucgagagcuccuacgugugcagcggccuggugggggacacgccccgcaacgacgacuccagcuccagcuccaacugccggggccccaacaacgagcgcggggcgcccggcgucaaggggugggccuucgacgacggcaacgacguguggaugggccggaccaucaagaacgggagccgcuccggcuacgagaccuuccggguggucaacggguggaccauggccaacagcaagucccagaucaaccgccaggugaucguggacagcgacgacuggagcggcuacuccgggaucuucagcgucgagggcaagaagugcaucaaccggugcuucuacguggagcugauccgcggccgcccgcaggagccccgggucugguggacguccaacagcaucaucguguucugcgggaccuccggcaccuacgggaccggcagcuggcccgacggggccaacaucaacuucaugcccaucuga

SEQ ID NO: 84593 - RNA, 1401 nt, Artificial Sequence
  derived and/or modified sequence opt1 from neuraminidase__InfluenzaA__AGQ81807
augaaccccaaccagaagaucaccgccaucggcagcaucucccugaucaucgccaucaucugccuccugaugcagaucgcgauccugaccacgaccaugacccuccacuuccgccagaacgagugccggaacccgagcaacaaccaggugaugcccugcgagcccgucaucaucgagcgcaacaccgugcaccugaacuccacgaccaucgagcgggagaucugccccaagguggccgaguacaagaacuggagcaagccgcagugccagaucaccggguucgcccccuucuccaaggacaacagcauccgccuguccgccagcggcgacaucugggucacccgggagcccuacguguccugcagccucaacaagugcuaccaguucgcccuggggcagggcacgacccugaagaacaagcacuccaacgggaccacccacgaccgcacgccccaccggacccuccugaugaacgagcugggcgugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccgcacccaggagagcgagugcgucugcaucaacgggaccugcgcgguggugaugaccgacggcagcgccuccggcaaggccgacacgcggguccuguucaucaaggaggggaagaucaucaacaucagcccccuguccggcagcgcccagcacguggaggagugcuccugcuacccccgcuaccccgaggugcggugcgucugccgcgacaacuggaaggggagcaaccggccgauccucuacaucaacauggccgacuacuccaucgagagcuccuacgugugcagcggccuggugggcgacacgccccgcaacgacgacuccagcuccagcuccaacugccgggaccccaacaacgagcgcggggcgcccggcgucaaggggugggccuucgacgacggcaacgacguguggauggggcggaccaucaagaacggcagccgcuccggcuacgagaccuuccggguggucaacggguggaucauggccaacagcaagucccagaucaaccgccaggugaucguggacagcgacgacuggagcggcuacuccgggaucuucagcgucgagggcaagaagugcaucaaccggugcuucuacguggagcugauccgcgggcgcccgcaggagccccgggucugguggaccuccaacagcaucaucguguucugcggcaccuccggcaccuacgggaccggcagcuggcccgacggggccaacaucaacuucaugcccaucuga

SEQ ID NO: 84594 - RNA, 1401 nt, Artificial Sequence
  derived and/or modified sequence opt1 from neuraminidase__InfluenzaA__AGQ81808
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccgucgagagcuccuacgugugcagcgggcuggugggcgacacgccccgcaacgacgacuccagcuccagcuccaacugccgggaccccaacaacgagcgcggggcgcccggcgucaaggggugggccuucgacgacggcaacgacguguggaugggccggaccauccgcaacaacagccgguccggguacgagaccuuccgcguggucaacggcuggaccaccgccaacagcaagucccagaucaaccggcagaucaucguggacagcgagaacuggagcggguacuccggcaucuucagcgucgaggggaagaacugcaucaaccgcugcuucuacguggagcugauccggggccgcccgcaggagccccgcgugugguggaccuccaacagcaucaucgucuucugcggcaccuccgggacguacggcaccgggagcuggcccgacggcgccaacaucaacuucaugcccaucuga

SEQ ID NO: 84595 - RNA, 1401 nt, Artificial Sequence
  derived and/or modified sequence opt1 from neuraminidase__InfluenzaA__AGQ81809
augaaccccaaccagaagaucaccgccaucggcagcgugucccugaucaucgccaucaucugccuccugaugcagaucgcgauccugaccacgaccaugacccuccacuuccgccagaacgagugcagcaacccguccaacaaccaggucaugcccugcgagcccaucaucaucgagcggaacaccgugcaccugaacagcacgaccaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggagcuccagcuccugcuacgacggcaaggccuggcuccacaucugcgugaccggggacgacaagaacgccacggccagcaucaucuacgacggcaugcugguggacuccaucgggagcugguccaagaacauccugcggacccaggagagcgagugcgucugcaucaacgggaccugcgcgguggugaugaccgacggcagcgccuccggggaggccgacacgcgcauccucuucauccgggagggcaagaucaucaacaucagcccccuguccgggagcgcccagcacgucgaggagugcuccugcuacccccgcuacccggaggugcggugcgugugccgcgacaacuggaagggcagcaaccggcccaucaucuacaucaacauggucgacuacuccaucggcagccgcuacgugugcuccgggcuggugggcgacacgccccggaacgacgacagcaccuccagcuccaacugccgcgaccccaacaacgagcggggcgccccgggcgucaaggggugggcguucgacgacggcaacgacguguggaugggccgcaccaucaagaacgggagccgguccggcuacgagaccuuccgcgugaucaacggguggaccauggccaacagcaagucccagaucaaccggcaggucaucguggacagcgacaacugguccggcuacagcgggaucuucagcguggagggcaagaagugcaucaaccgcugcuucuacgucgagcucauccgcggccggccccaggagccccgcgugugguggaccuccaacagcaucaucgucuucugcgggaccuccggcacguacgggaccggcagcuggcccgacggggccgacaucaacuucaugccgaucuga

SEQ ID NO: 84596 - RNA, 1401 nt, Artificial Sequence
  derived and/or modified sequence opt1 from neuraminidase__InfluenzaA__AGQ81810
augaaccccaaccagaagauccuggccaucggcagcgugucccucaccaucgccaucaucugcuuccugaugcagaucgcgauccugaccacgaccaugacccuccacuucaagcagaacgagugcagcaacccguccaacaaccaggucgugcccugcgagcccauccugaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcucagcgccggcggggacaucugggugacccgcgagcccuacgucuccugcagccugggcaagugcuaccaguucgcccuggggcagggcacgacccucaagaacaaccacuccaacggcaccacccacgaccggacgccccaccgcacccugcugaugaacgagcucggggugccguuccaccugggcaccaagcaggucugcaucgcguggagcuccagcuccugcuacgacgggaaggccuggcugcacaucugcgugaccggcgacgacaagaacgccacggccagcaucaucuacgacgggaugcucguggacuccaucggcagcugguccaagaacauccugcggacccaggagagcgagugcgugugcaucaacgggaccugcgcggucgugaugaccgacggcagcgccuccggcaaggccgacacgcgcauccuguucauccgggaggggaagaucaucaacaucagcccccucuccggcagcgcccagcacguggaggagugcuccugcuacccccgcuaccccgagguccggugcgugugccgcgacaacuggaagggcagcaaccggccggugcuguacaucaacauggccgacuacuccaucgagagcuccuacgucugcagcgggcuggugggcgacacgccccgcaacgacgacuccagcuccagcuccaacugccgggaccccaacaacgagcgcggggcgcccggcgugaaggggugggccuucgacgacggcaacgacgucuggaugggccggaccauccgcaacaacagccgguccggguacgagaccuuccgcguggugaacggcuggaccaccgccaacagcaagucccagaucaaccggcaggucaucguggacagcgagaacuggagcggguacuccggcaucuucagcgucgaggggaagaacugcaucaaccgcugcuucuacguggagcucauccggggccgcccgcaggagccccgcgugugguggaccuccaacagcaucaucgucuucugcggcaccuccgggacguacggcaccgggagcuggcccgacggcgccaacaucaacuucaugcccaucuga

SEQ ID NO: 84597 - RNA, 1401 nt, Artificial Sequence
  derived and/or modified sequence opt1 from neuraminidase__InfluenzaA__AGQ81811
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucgugaacaucagcccccuguccggcagcgcccagcacgucgaggagugcuccugcuacccccgcuaccccgaggugcggugcgugugccgcgacaacuggaagggcagcaaccggccgguccucuacaucaacauggccgacuacuccguggagagcuccuacgugugcagcgggcuggucggcgacacgccccgcaacgacgacuccuucagcuccagcaacugccgggaccccaacaacgagcgcggggcgcccggcgugaaggggugggccuucgacgacggcaacgacguguggaugggccggaccauccgcaacgacucccggagcggguacgagaccuuccgcgucgugaacggcuggaccaccgccaacuccaagagccagaucaaccggcaggucaucguggacuccgagagcuggagcggguacuccggcaucuucagcguggaggggaagaacugcaucaaccgcugcuucuacgucgagcugauccggggccgcccgcaggagccccgcgugugguggaccuccaacagcaucaucguguucugcggcaccuccgggacguacggcaccgggagcuggcccgacggcgccaacaucaacuucaugcccaucuga

SEQ ID NO: 84598 - RNA, 1410 nt, Artificial Sequence
  derived and/or modified sequence opt1 from neuraminidase__InfluenzaA__AGQ81812
augaaccccaaccagaagaucaucaccaucggcagcgugucccugaccaucgccacgaucugcuuccucaugcagaucgccauccuggucaccaccaucacccugcacuucaagcagaacgagugcagcaucccguccaacaaccagguggugcccugcgagcccaucaucgucgagcgcaacaucacggagaucguguaccucaacaacaccaccaucgagaaggagcugugccccaagcugaccgaguaccgggacuggagcaagccgcagugccagaucacgggguucgcgcccuucuccaaggacaacagcauccgccucuccgccggcggggacaucugggugacccgggagcccuacgucagcugcucccccaacaagugcuaccaguucgcccugggccaggggaccacccuggacaacaagcacagcaacggcacgauccacgaccgcaucccgcaccggacccuccugaugaacgagcugggcgugcccuuccaccucgggaccaagcaggucugcaucgccugguccagcuccagcugccacgacggcaaggccuggcugcacgugugcgugaccggggacgaccgcaacgcgacggccuccuucaucuacgacggcaugcugguggacagcaucggguccuggagccagaacauccuccggacccaggaguccgagugcgucugcaucaacgggaccugcaccguggugaugacggacggcagcgccagcggccgcgccgacacccggauccuguucaucaaggagggcaagaucguccacgugagcccccuguccggguccgcgcagcacaucgaggagugcagcugcuacccccgcuacccggacgugcggugcgucugccgcgacaacuggaagggcuccaaccggcccaucaucgacaucaacguggccgacuacagcaucgacuccagcuacgugugcuccggccucgucggggacacgccccgcaacgacgacagcuccagcaacuccaacugcaaggaccccaacaacgagcggggcaacccgggggugaagggcugggccuucgacuacgggaacgacguguggaugggccgcaccaucagcaaggacucccggagcggcuacgagaccuuccgcgucaucgggggcuggaccaccgccaacuccaagagccaggugaaccggcaggucaucguggacaacaacaacugguccggguacagcggcaucuucagcguggaggggaaguccugcaucaaccgcugcuucuacgucgagcugauccggggccgcccccaggagacccgcgugugguggacgagcaacuccaucguggucuucugcggcaccagcgggaccuacggcaccggguccuggcccgacggcgccaacaucaacuucaugcccaucuga

SEQ ID NO: 84599 - RNA, 1401 nt, Artificial Sequence
  derived and/or modified sequence opt1 from neuraminidase__InfluenzaA__AGQ81814
augaaccccaaccagaagaucaucgccaucggcagcgugucccugaccaucgccaucaugugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccgucgagagcuccuacgugugcagcgggcuggugggcgacacgccccgcaacgacgacuccagcuccagcuccaacugccgggaccccaacaacgagcgcggggcgcccggcgucaaggggugggccuucgacgacggcaacgacguguggaugggccggaccauccgcaacaacagccgguccggguacgagaccuuccgcguggucaacggcuggaccaccgccaacagcaagucccagaucaaccgccaggugaucgucgacagcgagaacuggagcggguacuccggcaucuucagcguggaggggaagaacugcaucaaccggugcuucuacguggagcugauccggggccgcccgcaggagccccgcgucugguggaccuccaacagcaucaucguguucugcggcaccuccgggacguacggcaccgggagcuggcccgacggcgccaacaucaacuucaugcccaucuga

SEQ ID NO: 84600 - RNA, 1401 nt, Artificial Sequence
  derived and/or modified sequence opt1 from neuraminidase__InfluenzaA__AGQ81815
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccgucgagagcuccuacgugugcagcgggcuggugggcgacacgccccgcaacgacgacuccagcuccagcuccaacugccgggaccccaacaacgagcgcgggacccccggcgucaaggggugggcguucgacgacggcaacgacguguggaugggccggaccauccgcaacgacagccgguccggguacgagaccuuccgcgugaucaacggcuggaccaccgccaacagcaagucccagaucaaccggcaggucaucguggacagcgagaacuggagcggguacuccggcaucuucagcgucgaggggaagaacugcaucaaccgcugcuucuacguggagcugauccggggccgcccgcaggagccccgcgugugguggaccuccaacagcaucaucgucuucugcggcacguccgggaccuacggcaccgggagcuggcccgacggcgccaacaucaacuacaugcccaucuga

SEQ ID NO: 84601 - RNA, 1401 nt, Artificial Sequence
  derived and/or modified sequence opt1 from neuraminidase__InfluenzaA__AGQ81816
augaaccccaaccagaagaucaucgccaucggcagcgugucccugaccaucgccaucaucugcuuccucaugcagaucgcgauccugaccacgaccaugacccugcacuucaagcagaacgggugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggcuucgcccccuucagcaaggacaacuccauccggcugagcgccgggggcgacaucugggugacccgcgagcccuacgucuccugcagccucgggaagugcuaccaguucgcccugggccagggcacgacccugaagaacaagcacuccaacgggaccacccacgaccggacgccccaccgcacccuccugaugaacgagcugggcgugccguuccaccucgggaccaagcaggucugcaucgcguggagcuccagcuccugcuacgacggcaaggccuggcugcacaucugcgugaccggggacgacaagaacgccacggccagcaucaucuacgacggcaugcugguggacuccaucggcagcugguccaagaacauccuccggacccaggagagcgagugcgugugcaucaacgggaccugcgcggucgugaugaccgacggcagcgccuccgggaaggccgacacgcgcauccuguucauccgggagggcaagaucaucaacaucagcccccuguccggcagcgcccagcacguggaggagugcuccugcuacccccgcuaccccgagguccggugcgugugccgcgacaacuggaaggggagcaaccggccggugcucuacaucaacauggccgacuacuccgucgagagcuccuacgugugcagcggccuggugggggacacgccccgcaacgacgacuccagcuccagcuccaacugccgggaccccaacaacgagcgcggcacccccggggucaagggcugggcguucgacgacggcaacgacguguggauggggcggaccauccgcaacgacagccgguccggcuacgagaccuuccgcgugaucaacggguggaccaccgccaacagcaagucccagaucaaccggcaggucaucguggacagcgagaacuggagcggcuacuccgggaucuucagcgucgagggcaagaacugcaucaaccgcugcuucuacguggagcugauccggggccgcccgcaggagccccgcgugugguggaccuccaacagcaucaucgucuucugcgggacguccggcaccuacgggaccggcagcuggcccgacggggccaacaucaacuacaugcccaucuga

SEQ ID NO: 84602 - RNA, 1401 nt, Artificial Sequence; identical to SEQ ID NO: 84600
  derived and/or modified sequence opt1 from neuraminidase__InfluenzaA__AGQ81817

SEQ ID NO: 84603 - RNA, 1401 nt, Artificial Sequence; identical to SEQ ID NO: 84600
  derived and/or modified sequence opt1 from neuraminidase__InfluenzaA__AGQ81818

SEQ ID NO: 84604 - RNA, 1401 nt, Artificial Sequence; identical to SEQ ID NO: 84600
  derived and/or modified sequence opt1 from neuraminidase__InfluenzaA__AGQ81819

SEQ ID NO: 84605 - RNA, 1401 nt, Artificial Sequence
  derived and/or modified sequence opt1 from neuraminidase__InfluenzaA__AGQ81820
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccaucgagagcuccuacgucugcagcgggcuggugggcgacacgccccgcaacgacgacuccagcuccagcuccaacugccgggaccccaacaacgagcgcgggacccccggcgugaaggggugggcguucgacgacggcaacgacgucuggaugggccggaccauccgcaacgacagccgguccggguacgagaccuuccgcgugaucaacggcuggaccaccgccaacagcaagucccagaucaaccgccaggugaucgucgacagcgagaacuggagcggguacuccggcaucuucagcguggaggggaagaacugcaucaaccggugcuucuacgucgagcugauccggggccgcccgcaggagcccaaggugugguggaccuccaacagcaucaucguguucugcggcacguccgggaccuacggcaccgggagcuggcccgacggcgccaacaucaacuucaugcccaucuga

SEQ ID NO: 84606 - RNA, 1401 nt, Artificial Sequence
  derived and/or modified sequence opt1 from neuraminidase__InfluenzaA__AGQ81822
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaagaaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccgucgagagcuccuacgugugcagcgggcuggugggcgacacgccccgcaacgacgacuccagcuccagcuccaacugccgggaccccaacaacgagcgcgggacccccggcgucaaggggugggcguucgacgacggcaacgacguguggaugggccggaccauccgcaacgacagccgguccggguacgagaccuuccgcgugaucaacggcuggaccaccgccaacagcaagucccagaucaaccggcaggucaucguggacagcgagaacuggagcggguacuccggcaucuucagcgucgaggggaagaacugcaucaaccgcugcuucuacguggagcugauccggggccgcccgcaggagccccgcgugugguggaccuccaacagcaucaucgucuucugcggcacguccgggaccuacggcaccgggagcuggcccgacggcgccaacaucaacuacaugcccaucuga

SEQ ID NO: 84607 - RNA, 1401 nt, Artificial Sequence
  derived and/or modified sequence opt1 from neuraminidase__InfluenzaA__AGQ81823
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaagcacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccgucgagagcuccuacgugugcagcgggcuggugggcgacacgccccgcaacgacgacuccagcuccagcuccaacugccgggaccccaacaacgagcgcggggcgcccggcgucaaggggugggccuucgacgacggcaacgacguguggaugggccggaccauccgcaacgacagccgguccggguacgagaccuuccgcguggucaacggcuggaccaccgccaacagcaagucccagaucaaccgccaggugaucgucgacagcgagaacuggagcggguacuccggcaucuucagcguggaggggaagaacugcaucaaccggugcuucuacguggagcugauccggggccgcccgcaggagccccgcgucugguggaccuccaacagcaucaucguguucugcggcaccuccgggacguacggcaccgggagcuggcccgacggcgccaacaucaacuucaugcccaucuga

SEQ ID NO: 84608 - RNA, 1401 nt, Artificial Sequence; identical to SEQ ID NO: 84607
  derived and/or modified sequence opt1 from neuraminidase__InfluenzaA__AGQ81824

SEQ ID NO: 84609 - RNA, 1401 nt, Artificial Sequence; identical to SEQ ID NO: 84607
  derived and/or modified sequence opt1 from neuraminidase__InfluenzaA__AGQ81825

SEQ ID NO: 84610 - RNA, 1401 nt, Artificial Sequence
  derived and/or modified sequence opt1 from neuraminidase__InfluenzaA__AGQ81831
augaaccccaaccagaagauccuggccaucggcagcgugucccucaccaucgccaucaucugcuuccugaugcagaucgcgauccugaccacgaccaugacccuccacuucaagcagaacgagugcagcaacccguccaacaaccaggucgugcccugcgagcccauccugaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcucagcgccggcggggacaucugggugacccgcgagcccuacgucuccugcagccugggcaagugcuaccaguucgcccuggggcagggcacgacccucaagaacaagcacuccaacggcaccacccacgaccggacgccccaccgcacccugcugaugaacgagcucggggugccguuccaccugggcaccaagcaggucugcaucgcguggagcuccagcuccugcuacgacgggaaggccuggcugcacaucugcgugaccggcgacgacaagaacgccacggccagcaucaucuacgacgggaugcucguggacuccaucggcagcugguccaagaacauccugcggacccaggagagcgagugcgugugcaucaacgggaccugcgcggucgugaugaccgacggcagcgccuccggcaaggccgacacgcgcauccuguucauccgggaggggaagaucgugaacaucagcccccucuccggcagcgcccagcacgucgaggagugcuccugcuacccccgcuaccccgaggugcggugcgugugccgcgacaacuggaagggcagcaaccggccgguccuguacaucaacauggccgacuacuccguggagagcuccuacgugugcagcgggcuggucggcgacacgccccgcaacgacgacuccuucagcuccagcaacugccgggaccccaacaacgagcgcggggcgcccggcgugaaggggugggccuucgacgacggcaacgacguguggaugggccggaccauccgcaacgacucccggagcggguacgagaccuuccgcgucgugaacggcuggaccaccgccaacuccaagagccagaucaaccggcaggucaucguggacuccgagagcuggagcggguacuccggcaucuucagcguggaggggaagaacugcaucaaccgcugcuucuacgucgagcucauccggggccgcccgcaggagccccgcgugugguggaccuccaacagcaucaucguguucugcggcaccuccgggacguacggcaccgggagcuggcccgacggcgccaacaucaacuucaugcccaucuga

SEQ ID NO: 84611 - RNA, 1401 nt, Artificial Sequence; identical to SEQ ID NO: 84600
  derived and/or modified sequence opt1 from neuraminidase__InfluenzaA__AGQ81837

SEQ ID NO: 84612 - RNA, 1401 nt, Artificial Sequence; identical to SEQ ID NO: 84600
  derived and/or modified sequence opt1 from neuraminidase__InfluenzaA__AGQ81838

SEQ ID NO: 84613 - RNA, 1401 nt, Artificial Sequence; identical to SEQ ID NO: 84607
  derived and/or modified sequence opt1 from neuraminidase__InfluenzaA__AGQ81839

SEQ ID NO: 84614 - RNA, 1401 nt, Artificial Sequence; identical to SEQ ID NO: 84607
  derived and/or modified sequence opt1 from neuraminidase__InfluenzaA__AGQ81840

SEQ ID NO: 84615 - RNA, 1401 nt, Artificial Sequence; identical to SEQ ID NO: 84600
  derived and/or modified sequence opt1 from neuraminidase__InfluenzaA__AGQ81841

SEQ ID NO: 84616 - RNA, 1410 nt, Artificial Sequence
  derived and/or modified sequence opt1 from neuraminidase__InfluenzaA__AGQ81843
augaaccccaaccagaagaucaucaccaucggcguggucaacaccacgcugagcaccaucgcccuccugaucgggaucggcaaccugaucuucaacaccgugauccacgagaagaucggggugcaccagaccgucguguacccgacgaucaccccgcccgugauccccaacugcuccgacaccaccaucacguacaacaacaccgucgugaacaacaucaccaccacgaucaucaacaaggccgagaagcaguucaagcccagccucccccugugccccuuccgcggcuucuuccccuuccacaaggacaacgcgauccggcugggggagaacaaggacgugaucgucacccgcgagccguacguguccugcgacaacgacgacugcuggagcuucgcccucgcccagggcgcccugcugggcaccaagcacuccaacgggaccaucaaggaccggacgcccuaccgcagccucauccgguuccccaucggcaccgcccccgugcuggggaacuacaaggagaucugcgucgcgugguccagcuccagcugcuucgacggcaaggaguggaugcacgugugcaugaccgggaacgacaacgacgccuccggccagaucaucuacgccggcaagaugaccgacagcaucaaguccuggcgccgggacauccugcgcacgcaggagagcgagugccagugcaucgacgggaccugcaucguggccgucaccgacggcccggcggccuccagcgccgaccaccggaucuacuggauccgcgaggggaagaucaucaaguacgaggacauccccaagaccaagauccagcaccucgaggagugcuccugcuacguggacacggacguguacugcaucugccgggacaacuggaagggcagcaaccgccccuggaugcggaucaacaacgagaccauccuggagaccggcuacgucugcuccaaguuccacagcgacacgccccgcccggccgaccccagcaccguguccugcgacagccccuccaacaucaacgggggccccggggugaagggcuucggguuccgggccggcaacgacgucuggcugggccgcaccgugagcaccaccgggcgguccggcuucgaggugaucaaggucacggagggguggaucaacagccucaaccacgcgaaguccgugacccagacccuggucagcaacaacgacugguccggcuacagcggguccuucaucguggagaacaacggcugcuuccagccgugcuucuacaucgagcugauccgcggccggcccaaccgcaacgacgacgugagcuggaccuccaacagcaucgucacguucugcgggcucgacaacgagcccggcuccgggaacuggcccgacggcagcaacaucggguucaugccgaaguga

SEQ ID NO: 84617 - RNA, 1410 nt, Artificial Sequence
  derived and/or modified sequence opt1 from neuraminidase__InfluenzaA__AGQ81845
augaaccccaaccagaagaucaucaccaucggcguggucaacaccacgcugagcaccaucgcccuccugaucgggaucggcaaccugaucuucaacaccgugauccacgagaagaucggggugcaccagaccgucaucuacccgacgaucaccucccccguggugcccaacugcagcgacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugagcugcgacaacgacgacugcugguccuucgcccucgcccagggcgcccugcugggcaccaagcacagcaacgggaccaucaaggaccgcacgccguaccggucccucauccgcuuccccaucggcaccgcccccguccuggggaacuacaaggagaucugcguggcguggagcuccagcuccugcuucgacggcaaggaguggaugcacgugugcaugaccgggaacgacaacgacgccagcggccagaucaucuacgccggcaagaugaccgacuccaucaagagcuggcggcgcgacauccugcggacgcaggaguccgagugccagugcaucgacgggaccugcaucgucgccgugaccgacggccccgcggccaacagcgccgaccaccgcaucuacuggauccgggaggggaagaucaucaaguacgagaacaucccgaagaccaagauccagcaccucgaggagugcuccugcuacguggacacggacgucuacugcaucugccgcgacaacuggaagggcagcaaccggcccuggaugcgcaucaacaacgagaccauccuggagaccggcuacgugugcuccaaguuccacagcgacacgccccggcccgccgacccgagcaccguguccugcgacagccccuccaacaucaacgggggccccggggucaagggcuucggguuccgcaccggcaacgacguguggcugggccggaccgugagcaccacggggcgcuccggcuucgaggucaucaaggugaccgagggguggaucaacagccucaaccacgccaaguccgucacccagacccuggugagcaacuccgacuggagcggcuacuccgggagcuucaucguggagaacaacggcugcuuccagcccugcuucuacaucgagcugauccggggccgcccgaacaagaacgacgacgucuccuggacgagcaacuccaucgugaccuucugcgggcucgacaacgagcccggcagcgggaacuggcccgacggcuccaacaucggguucaugcccaaguga

SEQ ID NO: 84618 - RNA, 1410 nt, Artificial Sequence; identical to SEQ ID NO: 84617
  derived and/or modified sequence opt1 from neuraminidase__InfluenzaA__AGQ81846

SEQ ID NO: 84619 - RNA, 1410 nt, Artificial Sequence; identical to SEQ ID NO: 84617
  derived and/or modified sequence opt1 from neuraminidase__InfluenzaA__AGQ81847

SEQ ID NO: 84620 - RNA, 1410 nt, Artificial Sequence
  derived and/or modified sequence opt1 from neuraminidase__InfluenzaA__AGQ81848
augaaccccaaccagaagaucaucaccaucggcguggucaacaccacgcugagcaccaucgcccuccugaucgggaucggcaaccugaucuucaacaccgugauccacgagaagaucggggugcaccagaccgucaucuacccgacgaucaccucccccguggugcccaacugcagcgacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugagcugcgacaacgacgacugcugguccuucgcccucgcccagggcgcccugcugggcaccaagcacagcaacgggaccaucaaggaccgcacgccguaccggucccucauccgcuuccccaucggcaccgcccccguccuggggaacuacaaggagaucugcguggcguggagcuccagcuccugcuucgacggcaaggaguggaugcacgugugcaugaccgggaacgacaacgacgccagcggccagaucaucuacgccggcaagaugaccgacuccaucaagagcuggcggcgcgacauccugcggacgcaggaguccgagugccagugcaucgacgggaucugcaucgucgccgugaccgacggccccgcggccaacagcgccgaccaccgcaucuacuggauccgggaggggaagaucaucaaguacgagaacaucccgaagaccaagauccagcaccucgaggagugcuccugcuacguggacaccgacgucuacugcaucugccgcgacaacuggaagggcagcaaccggcccuggaugcgcaucaacaacgagacgauccuggagaccggcuacgugugcuccaaguuccacagcgacacgccccggcccgccgacccgagcaccguguccugcgacagccccuccaacaucaacgggggccccggggucaagggcuucggguuccgcaccggcaacgacguguggcugggccggaccgugagcaccaccgggcgcuccggcuucgaggucaucaaggugacggagggguggaucaacagccucaaccacgccaaguccgucacccagacccuggugagcaacuccgacuggagcggcuacuccgggagcuucaucguggagaacaacggcugcuuccagcccugcuucuacaucgagcugauccggggccgcccgaacaagaacgacgacgucuccuggaccagcaacuccaucgugacguucugcgggcucgacaacgagcccggcagcgggaacuggcccgacggcuccaacaucggguucaugcccaaguga

SEQ ID NO: 84621 - RNA, 1410 nt, Artificial Sequence
  derived and/or modified sequence opt1 from neuraminidase__InfluenzaA__AGQ81850
augaaccccaaccagaagaucaucaccaucggcguggucaacaccacgcugagcaccaucgcccuccugaucgggaucggcaaccugaucuucaacaccgugauccacgagaagaucggggugcaccagaccgucaucuacccgacgaucaccucccccguggugcccaacugcagcgacaccaccaucacguacaacaacaccgucgugaacaacaucaccaccacggugaucaacaaggccgagaagcacuucaagcccucccucccgcugugccccuucaagggcuucuuccccuuccacaaggacaacgcgauccgccugggggagaacaaggacgucaucgugacccgggagcccuacgugagcugcgacaacgacgacugcugguccuucgcccucgcccagggcgcccugcugggcaccaagcacagcaacgggaccaucaaggaccgcacgccguaccggucccucauccgcuuccccaucggcaccgcccccguccuggggaacuacaaggagaucugcguggcguggagcuccagcuccugcuucgacggcaaggaguggaugcacgugugcaugaccgggaacgacaacgacgccaccggccagaucaucuacgccggcaagaugacggacagcaucaaguccuggcggcgcgacauccugcggacccaggagagcgagugccagugcaucgacgggaccugcaucgucgccgugaccgacggccccgcggccaacuccgccgaccaccgcaucuacuggauccgggaggggaagaucaucaaguacgagaacaucccgaagacgaagauccagcaccucgaggagugcagcugcuacguggacaccgacgucuacugcaucugccgcgacaacuggaagggcuccaaccggcccuggaugcgcaucaacaacgagaccauccuggagaccggcuacgugugcagcaaguuccacuccgacacgccccggcccgccgacccgagcaccgugagcugcgacucccccagcaacaucaacgggggccccggggucaagggcuucggguuccgcaccggcaacgacguguggcugggccggaccguguccacgaccgggcgcagcggcuucgaggucaucaaggugaccgagggguggaucaacucccucaaccacgccaagagcgucacccagacgcugguguccaacagcgacugguccggcuacagcggguccuucaucguggagaacaacggcugcuuccagcccugcuucuacaucgagcugauccggggccgcccgaacaagaacgacgacgucagcuggaccuccaacagcaucgugaccuucugcgggcucgacaacgagcccggcuccgggaacuggcccgacggcagcaacaucggguucaugcccaaguga

SEQ ID NO: 84622 - RNA, 1410 nt, Artificial Sequence
  derived and/or modified sequence opt1 from neuraminidase__InfluenzaA__AGQ81852
augaaccccaaccagaagaucaucaccaucggcguggucaacaccacgcugagcaccaucgcccuccugaucgggaucggcaaccugaucuucaacaccgugauccacgagaagaucggggugcaccagaccgucacguacccgaccaucaccucccccguggugcccaacugcagcgacaccacgaucaccuacaacaacaccgucgugaacaacaucaccacgaccgugaucaacaaggccgagaagcacuucaagcccucccucccgcugugccccuucaagggcuucuuccccuuccacaaggacaacgcgauccgccugggggagaacaaggacgucaucgugacccgggagcccuacgugagcugcgacaacgacgacugcugguccuucgcccucgcccagggcgcccugcugggcaccaagcacagcaacgggacgaucaaggaccgcaccccguaccggucccucauccgcuuccccaucggcaccgcccccguccuggggaacuacaaggagaucugcguggcguggagcuccagcuccugcuucgacggcaaggaguggaugcacgugugcaugaccgggaacgacaacgacgccacgggccagaucaucuacgccggcaagaugaccgacagcaucaaguccuggcggcgcgacauccugcggacccaggagagcgagugccagugcaucgacgggaccugcaucgucgccgugacggacggccccgcggccaacuccgccgaccaccgcaucuacuggauccgggaggggaagaucaucaaguacgagaacaucccgaagaccaagauccagcaccucgaggagugcagcugcuacguggacaccgacgucuacugcaucugccgcgacaacuggaagggcuccaaccggcccuggaugcgcaucaacaacgagaccauccuggagacgggcuacgugugcagcaaguuccacuccgacacgccccggcccgccgacccgagcaccgugagcugcgacucccccagcaacaucaacgggggccccggggucaagggcuucggguuccgcaccggcaacgacguguggcugggccggaccguguccaccaccgggcgcagcggcuucgaggucaucaaggugaccgagggguggaucaacucccucaaccacgccaagagcgucacgcagacccugguguccaacagcgacugguccggcuacagcggguccuucaucguggagaacaacggcugcuuccagcccugcuucuacaucgagcugauccggggccgcccgaaccggaacgacgacgucagcuggaccuccaacagcaucgugaccuucugcgggcucgacaacgagcccggcuccgggaacuggcccgacggcagcaacaucggguucaugcccaaguga

SEQ ID NO: 84623 - RNA, 1410 nt, Artificial Sequence
  derived and/or modified sequence opt1 from neuraminidase__InfluenzaA__AGQ81853
augaaccccaaccagaagaucaucaccaucggcguggucaacaccacgcugagcaccaucgcccuccugaucgggaucggcaaccugaucuucaacaccgugauccacgagaagaucggggugcaccagaccgucacguacccgaccaucaccucccccguggugcccaacugcagcgacaccacgaucaccuacaacaacaccgucgugaacaacaucaccacgaccgugaucaacaaggccgagaagcacuucaagcccucccucccgcugugccccuucaagggcuucuuccccuuccacaaggacaacgcgauccgccugggggagaacaaggacgucaucgugacccgggagcccuacgugagcugcgacaacgacgacugcugguccuucgcccucgcccagggcgcccugcugggcaccaagcacagcaacgggacgaucaaggaccgcaccccguaccggucccucauccgcuuccccaucggcaccgcccccguccuggggaacuacaaggagaucugcguggcguggagcuccagcuccugcuucgacggcaaggaguggaugcacgugugcaugaccgggaacgacaacgacgccacgggccagaucaucuacgccggcaagaugaccgacagcaucaaguccuggcggcgcgacauccugcggacccaggagagcgagugccagugcaucgacgggaccugcaucgucgccgugacggacggccccgcggccaacuccgccgaccaccgcaucuacuggauccgggaggggaagaucaucaaguacgagaacaucccgaagaccaagauccagcaccucgaggagugcagcugcuacguggacaccgacgucuacugcaucugccgcgacaacuggaagggcuccaaccggcccuggaugcgcaucaacaacgagaccauccuggagacgggcuacgugugcagcaaguuccacuccgacacgccccggcccgccgacccgagcaccgugagcugcgacucccccagcaacaucaacgggggccccggggucaagggcuucggguuccgcaccggcaacgacguguggcugggccggaccguguccaccaccgggcgcagcggcuucgaggucaucaaggugaccgagggguggaucaacucccucaaccacgccaagagcgucacgcagacccugguguccaacagcgacugguccggcuacagcggguccuucaucguggagaacaacggcugcuuccagcccugcuucuacaucgagcugauccggggccgcccgaacaagaacgacgacgucagcuggaccuccaacagcaucgugaccuucugcgggcucgacaacgagcccggcuccgggaacuggcccgacggcagcaacaucggguucaugcccaaguga

SEQ ID NO: 84624 - RNA, 1410 nt, Artificial Sequence; identical to SEQ ID NO: 84623
  derived and/or modified sequence opt1 from neuraminidase__InfluenzaA__AGQ81854

SEQ ID NO: 84625 - RNA, 1410 nt, Artificial Sequence; identical to SEQ ID NO: 84623
  derived and/or modified sequence opt1 from neuraminidase__InfluenzaA__AGQ81855

SEQ ID NO: 84626 - RNA, 1410 nt, Artificial Sequence; identical to SEQ ID NO: 84616
  derived and/or modified sequence opt1 from neuraminidase__InfluenzaA__AGQ81856

SEQ ID NO: 84627 - RNA, 1410 nt, Artificial Sequence
  derived and/or modified sequence opt1 from neuraminidase__InfluenzaA__AGQ81857
augaaccccaaccagaagaucaucaccaucggcguggucaacaccacgcugagcaccaucgcccuccugaucgggaucggcaaccugaucuucaacaccgugauccacgagaagaucggggugcaccagaccgucguguacccgacgaucaccccgcccgugauccccaacugcuccgacaccaccaucacguacaacaacaccgucgugaacaacaucaccaccacgaucaucaacaaggccgagaagcaguucaagcccagccucccccugugccccuuccgcggcuucuuccccuuccacaaggacaacgcgauccggcugggggagaacaaggacgugaucgucacccgcgagccguacguguccugcgacaacgacgacugcuggagcuucgcccucgcccagggcgcccugcugggcaccaagcacuccaacgggaccaucaaggaccggacgcccuaccgcagccucauccgguuccccaucggcaccgcccccgugcuggggaacuacaaggagaucugcgucgcgugguccagcuccagcugcuucgacggcaaggaguggaugcacgugugcaugaccgggaacgacaacgacgccuccggccagaucaucuacgccggcaagaugaccgacagcaucaaguccuggcgccgggacauccugcgcacgcaggagagcgagugccagugcaucgacgggaccugcaucguggccgucaccgacggcccggcggccuccagcgccgaccaccggaucuacuggauccgcgaggggaagaucaucaaguacgaggacauccccaagaccaagauccagcaccucgaggagugcuccugcuacguggacacggacguguacugcaucugccgggacaacuggaagggcagcaaccgccccuggaugcggaucaacaacgagaccauccuggagaccggcuacgucugcuccaaguuccacagcgacacgccccgcccggccgaccccagcaccguguccugcgacagccccuccaacaucaacgggggccccggggugaagggcuucggguuccgggccggcaacgacgucuggcugggccgcaccgugagcaccaccgggcgguccggcuucgaggugaucaaggucacggagggguggaucaacagccucaaccacgcgaaguccgugacccagacccuggucagcaacaacgacugguccggcuacagcggguccuucaucguggagagcaacggcugcuuccagccgugcuucuacaucgagcugauccgcggccggcccaaccgcaacgacgacguguccuggaccagcaacuccaucgucacguucugcgggcucgacaacgagcccggcagcgggaacuggcccgacggcuccaacaucggguucaugccgaaguga

SEQ ID NO: 84628 - RNA, 1410 nt, Artificial Sequence
  derived and/or modified sequence opt1 from neuraminidase__InfluenzaA__AGQ81858
augaaccccaaccagaagaucaucaccaucggcguggucaacaccacgcugagcaccaucgcccuccugaucggggugggcaaccugaucuucaacaccgugauccacgagaagaucggggaccaccagaucgucguguacccgaccacgaccgccuccgugguccccaacugcagcgacaccaucaucaccuacaacaacacgguggugaacaacaucaccaccaccaucaucacgaaggaggagacccacuucaaguccagccucccccugugccccuuccgcggcuucuucccguuccacaaggacaacgcgauccggcugggggagaacaaggacgucaucgugacccgcgagcccuacguguccugcgacaacgacgacugcuggagcuucgcccucgcccagggcgcccugcugggcaccaagcacuccaacgggacgaucaaggaccggacccccuaccgcagccucauccgguuccccaucggcaccgccccgguccuggggaacuacaaggagaucugcguggcgugguccagcuccagcugcuucgacggcaaggaguggaugcacgugugcaugaccgggaacgacaacgacgccuccggccagaucauguacgccggcaagaugacggacagcaucaaguccuggcgcaaggacauccugcggacccaggagagcgagugccagugcaucgacgggaccugcaucgucgccgugaccgacggccccgcgacgaacuccgccgaccaccgcaucuacuggauccgggaggggaagaucaucaaguacgagaacauccccaagaccaagauccagcaccucgaggagugcagcugcuacguggacaucgacgucuacugcgugugccgcgacaacuggaagggcuccaaccggcccuggaugcgcaucaacaacgagaccauccuggagaccggcuacgugugcagcaaguuccacagcgacacgccgcggcccgccgaccccuccaccgucagcugcgacucccccagcaacgugaacgggggcccgggggugaagggcuucggguucaagaccggcaacgacgucuggcugggccgcaccguguccacgagcgggcgguccggcuucgagaucaucaaggucaccgagggguggaucaacagccccaaccacgccaaguccgugacccagacccucgugagcaacaacgacugguccggcuacagcggguccuucaucgucgagaacaacggcugcuuccagcccugcuucuacaucgagcugauccgcggccggcccaacaagaacgacgacgugagcuggacguccaacagcaucgugaccuucugcgggcuggacaacgagccgggcuccgggaacuggcccgacggcagcaacaucggguucaugcccaaguga

SEQ ID NO: 84629 - RNA, 1410 nt, Artificial Sequence
  derived and/or modified sequence opt1 from neuraminidase__InfluenzaA__AGQ81859
augaaccccaaccagaagaucaucaccaucggcguggucaacaccacgcugagcaccaucgcgcuccugaucgggaucggcaaccugaucuucaacaccgugauccacgagaagaucggggugcaccagaccgucgugugcccgacgaucaccccgcccgugguccccaacugcuccgacaccaccaucacguacaacaacaccguggugaacaacaucaccaccacgaucaucaacaaggccgagaagcaguucaagagcucccucccccugugccccuuccgcggcuucuuccccuuccacaaggacaacgcgauccggcugggggagaacaaggacgucaucgugacccgcgagcccuacgugagcugcgacaacgacgacugcugguccuucgcccucgcccagggcgcccugcugggcaccaagcacagcaacgggaccaucaaggaccggacgccguaccgcucccucauccgguuccccaucggcaccgcccccguccuggggaacuacaaggagaucugcguggcguggagcuccagcuccugcuucgacggcaaggaguggaugcacaucugcaugaccgggaacgacaacgacgccagcggccagaucaucuacgccggcaagaugaccgacuccaucaagagcuggcgccgggacauccugcgcacgcaggaguccgagugccagugcaucgacgggaccugcaucguggccaucaccgacggccccgcggccagcuccgccgaccaccggaucuacuggauccgcgaggggaagaucaucaaguacgagaacaucccgaagaccaagauccagcaccucgaggagugcagcugcuacgucgacaucgacguguacugcaucugccgggacaacuggaagggcuccaaccgccccuggaugcggaucaacaacgagacgauccuggagaccggcuacgugugcagcaaguuccacagcgacacgccccgccccgccgacccguccaccgucagcugcgacucccccagcaacaucaacgggggccccggggugaagggcuucggguuccgggccggcaacgacguguggcugggccgcaccgucuccaccaccgggcggagcggcuucgaggugaucaaggugaccgagggguggaucaacucccucaaccacgccaagagcgucacgcagacccugguguccaacagcgacugguccggcuacagcggguccuucaucgucgagaacaacggcugcuuccagcccugcuucuacaucgagcugauccgcggccggccgaaccgcaacgacgacgugagcuggaccuccaacagcaucgugaccuucugcgggcucgacaacgagcccggcuccgggaacuggcccgacggcagcaacaucggguucaugcccaaguga

SEQ ID NO: 84630 - RNA, 1413 nt, Artificial Sequence
  derived and/or modified sequence opt1 from neuraminidase__InfluenzaA__AGQ81860
augaaccccaaccagaagaucaucugcaucagcgccaccggcaugacccuguccguggucagccuccugaucgggaucgccaaccugggccucaacaucgggcugcacuacaaggugggcgacacgccggacguguccauccccaacaugaacgagaccaacagcaccaccacgaucaucaacaacaacacccagaacaacuucaccaacaucaccaacaucaucgucaacaagaacgaggagaagacguuccugaaccucaccaagccccugugcgaggugaacuccuggcacauccugagcaaggacaacgcgauccgcaucggggaggacgcccacauccucgugacccgggagcccuaccuguccugcgacccgcagggcugccgcauguucgcccugagccagggcaccacgcuccgggggcgccacgccaacggcaccauccacgaccggucccccuuccgcgcccuggucagcugggagauggggcaggcgcccucccccuacaacgugaagguggagugcgucggcuggagcuccaccagcugccacgacgggaucucccggaugagcaucugcauguccggcccgaacaacaacgccagcgccguggugugguacggcgggcgccccgucaccgagauccccuccugggccggcaacauccugcggacgcaggagagcgagugcgugugccacaaggggaucugccccguggucaugaccgacggcccggcgaacaaccgcgccgccaccaagaucaucuacuucaaggagggcaagauccagaagaucgaggagcucgccgggagcgcccagcacaucgaggagugcuccugcuacggcgcgguggaggugaucaagugcaucugccgggacaacuggaagggggccaaccgccccgucaucaccaucaaccccgagaugaugacgcacaccagcaaguaccugugcuccaaggugcugaccgacaccagccggcccaacgacccgacgaacggcaacugcgacgcccccaucaccgggggcucccccgaccccggcgugaagggguucgccuuccucgacggcgagaacagcuggcuggggcgcaccaucuccaaggacagccgguccggcuacgagaugcugaaggucccgaacgccgagaccgacacgcagagcgggcccaccucccaccaggugaucgugaacaaccagaacuggagcggcuacuccggcgcguucaucgacuacugggccaacaaggagugcuucaaccccugcuucuacgucgagcucauccgcgggcggcccaaggagagcuccgugcuguggaccagcaacuccaucgucgcccugugcggcagcaaggagcgccucggguccuggagcuggcacgacggcgccgagaucaucuacuucaaguga

SEQ ID NO: 84631 - RNA, 1413 nt, Artificial Sequence
  derived and/or modified sequence opt1 from neuraminidase__InfluenzaA__AGQ81861
augaaccccaaccagaagaucaucugcaucagcgccaccggcaugacccuguccguggucagccuccugaucgggaucgccaaccugggccucaacaucgggcugcacuacaaggugggcgacacgccggacguguccauccccaacaugaacgagaccaacagcaccaccacgaucaucaacaacaacacccagaacaacuucaccaacaccacgaacaucaucgucaacaagaacgaggagaagaccuuccugaaccucaccaagccccugugcgaggugaacuccuggcacauccugagcaaggacaacgcgauccgcaucggggaggacgcccacauccucgugacccgggagcccuaccuguccugcgacccgcagggcugccgcauguucgcccugagccagggcacgacccuccgggggcgccacgccaacggcaccauccacgaccggucccccuuccgcgcccuggucagcugggagauggggcaggcgcccucccccuacaacgugaagguggagugcgucggcuggagcuccaccagcugccacgacgggaucucccggaugagcaucugcauguccggcccgaacaacaacgccagcgccguggugugguacggcgggcgccccgucacggagauccccuccugggccggcaacauccugcggacccaggagagcgagugcgugugccacaaggggaucugccccguggucaugaccgacggcccggcgaacaaccgcgccgccaccaagaucaucuacuucaaggagggcaagauccagaagaucgaggagcucgccgggagcgcccagcacaucgaggagugcuccugcuacggcgcgguggaggugaucaagugcaucugccgggacaacuggaagggggccaaccgccccgucaucacgaucaaccccgagaugaugacccacaccagcaaguaccugugcuccaaggugcugaccgacacgagccggcccaacgacccgaccaacggcaacugcgacgcccccaucaccgggggcucccccgaccccggcgugaagggguucgccuuccucgacggcgagaacagcuggcuggggcgcaccaucuccaaggacagccgguccggcuacgagaugcugaaggucccgaacgccgagacggacacccagagcgggcccaccucccaccaggugaucgugaacaaccagaacuggagcggcuacuccggcgcguucaucgacuacugggccaacaaggagugcuucaaccccugcuucuacgucgagcucauccgcgggcggcccaaggagagcuccgugcuguggaccagcaacuccaucgucgcccugugcggcagcaaggagcgccucggguccuggagcuggcacgacggcgccgagaucaucuacuucaaguga

SEQ ID NO: 84632 - RNA, 1413 nt, Artificial Sequence
  derived and/or modified sequence opt1 from neuraminidase__InfluenzaA__AGQ81862
augaaccccaaccagaagaucaucugcaucagcgccaccggcaugacccuguccguggucagccuccugaucgggaucgccaaccugggccucaacaucgggcugcacuacaaggugggcgacacgccggacgugaacauccccuccaugaacgagaccaacagcaccaccacgaucaucaacaacaacacccagaacaacuucaccaacaucaccaacaucaucgucaacaaggaggaggggcgcacguuccugaaccucaccaagccccugugcgaggugaacuccuggcacauccugagcaaggacaacgcgauccggaucggcgaggacgcccacauccucgugacccgcgagcccuaccuguccugcgacccgcagggcugccggauguucgcccugagccaggggaccacgcuccgcggccggcacgccaacgggaccauccacgaccgcucccccuuccgggcccuggucagcugggagaugggccaggcgcccucccccuacaacgugcgcguggagugcaucggguggagcuccaccagcugccacgacggcaucucccggaugagcaucugcauguccggcccgaacaacaacgccagcgccgucgugugguacgggggccgccccgugaccgagauccccuccugggccgggaacauccugcggacgcaggagagcgagugcgucugccacaagggcaucugccccguggugaugaccgacggcccggcgaacaaccgcgccgccaccaagaucaucuacuucaaggaggggaagauccagaagaucgaggagcucgagggcaacgcccagcacaucgaggagugcagcugcuacggggccgcgggcgucaucaagugcaucugccgggacaacuggaagggggccaaccgccccgugaucaucaucgaccccgagaugaugacccacacguccaaguaccugugcagccgggugcugaccgacaccucccgccccaacgacccgaccagcggcaacugcgacgcccccaucacgggcgggucccccgaccccggcgucaagggguucgccuuccucgacggcgagaacagcuggcuggggcggaccaucuccaaggacagccgcuccggcuacgagaugcugaaggugccgaacgccgagaccgacacccagagcggccccacgucccaccaggugaucgucaacaaccagaacuggagcggguacuccggcgcguucaucgacuacugggccaacaaggagugcuucaaccccugcuucuacguggagcucauccgggggcgccccaaggagagcuccgugcuguggaccagcaacuccaucgucgcccugugcggcagcaaggagcggcucggguccuggagcuggcacgacggcgccgagaucaucuacuucaaguga

SEQ ID NO: 84633 - RNA, 1413 nt, Artificial Sequence
  derived and/or modified sequence opt1 from neuraminidase__InfluenzaA__AGQ81863
augaaccccaaccagaagaucaucugcaucagcgccaccggcaugacccuguccguggucagccuccugaucgggaucgccaaccugggccucaacaucgggcugcacuacaaggugggcgacacgccggacgugaacauccccuccaugaacgagaccaacagcaccaccacgaucaucaacaacaacacccagaacaacuucaccaacaucaccaacaucaucgucaacaaggaggaggagcgcacguuccugaaccucaccaagccccugugcgaggugaacuccuggcacauccugagcaaggacaacgcgauccggaucggggaggacgcccacauccucgugacccgcgagcccuaccuguccugcgacccgcagggcugccggauguucgcccugagccagggcaccacgcuccgcgggcggcacgccaacggcaccauccacgaccgcucccccuuccgggcccuggucagcugggagauggggcaggcgcccucccccuacaacgugcgcguggagugcaucggcuggagcuccaccagcugccacgacgggaucucccggaugagcaucugcauguccggcccgaacaacaacgccagcgccgucgugugguacggcgggcgccccgugaccgagauccccuccugggccggcaacauccugcggacgcaggagagcgagugcgucugccacaaggggaucugccccguggugaugaccgacggcccggcgaacaaccgcgccgccaccaagaucaucuacuucaaggagggcaagauccagaagaucgaggagcucgaggggaacgcccagcacaucgaggagugcagcugcuacggcgccgcgggggucaucaagugcaucugccgggacaacuggaagggcgccaaccgccccgugaucaucaucgaccccgagaugaugacccacacguccaaguaccugugcagccgggugcugaccgacaccucccgccccaacgacccgaucagcgggaacugcgacgcccccaucaccggcggcucccccgaccccggggucaagggcuucgccuuccucgacggggagaacagcuggcugggccggacgaucuccaaggacagccgcuccggguacgagaugcugaaggugccgaacgccgagaccgacacccagagcggccccaccucccaccaggugaucgucaacaaccagaacuggagcggcuacuccggggcguucaucgacuacugggccaacaaggagugcuucaaccccugcuucuacguggagcucauccggggccgccccaaggagagcuccgugcuguggacgagcaacuccaucgucgcccugugcgggagcaaggagcggcucggcuccuggagcuggcacgacggggccgagaucaucuacuucaaguga

SEQ ID NO: 84634 - RNA, 1416 nt, Artificial Sequence
  derived and/or modified sequence opt1 from neuraminidase__InfluenzaA__AGQ81864
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccaucgucgagaacaccuacgugaacaacacgaccaucaucuccaaggagaccgagcugaagccgcccaacuaccuccugcugaacaagagccucugcaacguggagggcugggucgugaucgccaaggacaacgccgugcgcuucggggaguccgagcagaucaucgucacccgggagcccuacgugagcugcgaccccacgggcugcaagauguacgcccugcaccagggcaccaccauccgcaacaagcacuccaacgggaccauccacgaccggacggccuuccgcggccugaucagcaccccgcucgggaccccgcccaccguguccaacagcgacuucaucugcgucggcugguccagcacgaccugccacgacgggaucggccggaugaccaucugcauccagggcaacaacgacaacgcgaccgccacgguguacuacaaccgccggcugaccaccaccaucaagacgugggcccgcaacauccugcggacccaggaguccgagugcgugugccacaacgggaccugcgccgucgugaugaccgacggcagcgcguccagccaggccuacacgaaggugauguacuuccacaaggggcucgucaucaaggaggaggcccugaagggcuccgcccgccacaucgaggagugcagcugcuacggccacagccagaaggcgaccugcgugugccgggacaacuggcagggggccaaccgccccaucaucgagaucgacaugaacacccuggagcacaccucccgguacgugugcacgggcauccucaccgacaccagccgccccggggacaaguccagcggcgacugcuccaaccccaucaccgggagccccggcgcccccggcgucaagggguucggcuuccugaacggggacaacacguggcugggccggaccaucucccccaagagccgcuccggguucgagaugcucaagauccccaacgccggcaccgaccccaacagccggaucgccgagcgccaggagaucguggacaacaacaacugguccggcuacagcggguccuucaucgacuacugggacaacgacagcgagugcuacaacccgugcuucuacguggagcugauccggggccgccccgaggaggccaaguacgucugguggaccuccaacagccugaucgcgcucugcgggucccccuuccccgugggcagcggguccuucccggacggcgcccagauccaguacuucagcuga

SEQ ID NO: 84635 - RNA, 1416 nt, Artificial Sequence
  derived and/or modified sequence opt1 from neuraminidase__InfluenzaA__AGQ81865
augaaccccaaccagaagcuguucgcccucagcggcguggccaucgcgcuguccguccugaaccuccugaucgggcugagcaacgugggccucaacgugucccugcaccugaaggagaccgggccgaagcaggagggcaaccugaccugcaugacgaucaaccagaacaacaccaccgucguggagaacaccuacgugaacaacacgaccaucaucaccaaggagaccgagagcgagacgcccaacuaccuccugcucaacaagucccugugcaacgucgagggguggguggugaucgccaaggacaacgccguccgcuucggcgagagcgagcagaucaucgugacccgggagcccuacguguccugcgaccccaacggcugcaagauguacgcccugcaccaggggaccaccauccgcaacaagcacagcaacggcacgauccacgaccggaccgccuuccgcgggcucaucuccaccccgcugggcaccccgcccacggucagcaacuccgacuucaucugcgugggguggagcuccacgaccugccacgacggcaucggccggaugaccaucugcauccaggggaacaacgacaacgcgaccgccaccguguacuacaaccgccggcugaccaccacgaucaagaccugggcccgcaacauccuccggacccaggagagcgagugcgucugccacaacgggaccugcgccguggugaugacggacggcuccgcgagcucccaggcccacaccaaggucauguacuuccacaagggccugguggugaaggaggaggcccugaagggcagcgcccgccacaucgaggagugcuccugcuacgggcacaaccagaaggugaccugcgucugccgggacaacuggcagggcgccaaccgccccaucaucgagaucgacaugaacacccucgagcacacgagccgguacgugugcaccgggauccugaccgacaccagccgccccggcgacaagcccacgggggacugcuccaaccccaucaccggcagccccggcgcgccgggggucaagggcuucggguuccugaacggcgggaacaccuggcucggccggaccaucagcccccgcucccgguccggcuucgagaugcugaagauccccaacgccgggaccgaccccaacagccgcaucgccgagcggcaggagaucguggacaacuccaacuggagcggcuacuccgggagcuucaucgacuacuggaacgacaacuccgagugcuacaacccgugcuucuacgucgagcugauccgcggccggcccgaggaggccaaguacgugugguggacgagcaacucccucaucgcccugugcgggagccccuuccccgugggcuccggcagcuucccggacggggcgcagauccaguacuucuccuga

SEQ ID NO: 84636 - RNA, 1416 nt, Artificial Sequence
  derived and/or modified sequence opt1 from neuraminidase__InfluenzaA__AGQ81868
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccgucguggagaacaccuacgugaacaacacgaccaucaucaccaaggagaccgagcugaagacgcccuccuaccuccugcugaacaagagccucugcaacgucgagggcuggguggugaucgccaaggacaacgccguccgcuucggggaguccgagcagaucaucgugacccgggagcccuacgugagcugcgaccccaccggcugcaagauguacgcccugcaccagggcaccacgauccgcaacaagcacuccaacgggaccauccacgaccggaccgccuuccgcggccugaucagcaccucccucgggacgccgcccaccaucagcaacuccgacuucaugugcgucggcuggagcuccacgaccugccacgacgggaucggccggaugaccaucugcauccagggcaacaacgacaacgcgaccgccaccguguacuacaaccgccggcugaccacgaccaucaagaccugggcccgcaacauccugcggacccaggagagcgagugcgugugccacaacgggaucugcgccgucgugaugacggacggcuccgcgagcucccaggccuacaccaaggugauguacuuccacaaggggcucgucgugaaggaggaggcccugaagggcagcgcccgccacaucgaggagugcagcugcuacggccacucccagaaggugaccugcgucugccgggacaacuggcagggggccaaccgccccaucaucgagaucgacaugaacacccuggagcacacgagccgguacgugugcaccggcauccucaccgacaccucccgccccggggacaagagcuccggcgacugcagcaacccgaucgcggggucccccggcgcccccggcgugaagggguucggcuuccugaacggggacaacacguggcugggccggaccaucagcccccgcucccggagcggguucgagaugcucaagaucccgaacgccggcaccgaccccaacucccgcaucgccggccggcaggagaucgucgacaacaacaacuggagcggguacuccggcagcuucaucgacuacuggaacgacaacuccgagugcuacaaccccugcuucuacguggagcugauccgcgggcggcccgaggaggccaaguacgucugguggaccagcaacucccugaucgcgcucugcggcagcccguuccccgugggguccggcagcuuccccgacggcgcccagauccaguacuucagcuga

SEQ ID NO: 84637 - RNA, 1416 nt, Artificial Sequence
  derived and/or modified sequence opt1 from neuraminidase__InfluenzaA__AGQ81869
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccaucgucgagaacaccuacgugaacaacacgaccaucaucuccaaggagaccgagcugaagacccccagcuaccuccugcugaacaagucccucugcaacguggagggcugggucgugaucgccaaggacaacgccgugcgcuucggggagagcgagcagaucaucgucacgcgggagcccuacguguccugcgaccccaccggcugcaagauguacgcccugcaccagggcaccaccauccgcaacaagcacagcaacgggacgauccacgaccggaccgccuuccgcggccugaucuccaccccgcucgggaccccgcccacggugagcaacuccgacuucaucugcgucggcuggagcuccacgaccugccacgacgggaucggccggaugaccaucugcauccagggcaacaacgacaacgcgaccgccaccguguacuacaaccgccggcugaccaccacgauccgcaccugggcccggaacauccugcgcacccaggagagcgagugcgugugccacaacgggaccugcgccgucgugaugacggacggcuccgcgagcucccaggccuacaccaaggugauguacuuccacaaggggcucgucaucaaggaggaggcccugaagggcagcgcccggcacaucgaggagugcagcugcuacggccacucccagaaggcgaccugcgugugccgcgacaacuggcagggggccaaccggcccaucaucgagaucgacaugaacacccuggagcacacgagccgcuacgugugcaccggcauccucaccgacaccucccggcccggggacaagagcuccggcgacugcagcaaccccaucacggggucccccggcgcccccggcgucaagggguucggcuuccugaacggggacaacaccuggcugggccgcaccaucagcccgcggucccgcagcggguucgagaugcucaagauccccaacgccggcaccgaccccaacucccggaucgccgagcgccaggagaucguggacaacaacaacuggagcggcuacuccgggagcuucaucgacuacuggaacaacgacuccgagugcuacaaccccugcuucuacguggagcugauccggggccgcccggaggaggccaaguacgucugguggaccagcaacucccugaucgcgcucugcgggagccccuuccccgugggcuccgggagcuuccccgacggcgcccagauccaguacuucagcuga

SEQ ID NO: 84638 - RNA, 1416 nt, Artificial Sequence
  derived and/or modified sequence opt1 from neuraminidase__InfluenzaA__AGQ81870
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccaucgucgagaacaccuacgugaacaacacgaccaucaucuccaaggagaccgagcugaagccgcccagcuaccuccugcugaacaagucccucugcaacguggagggcugggucgugaucgccaaggacaacgccgugcgcuucggggagagcgagcagaucaucgucacccgggagcccuacguguccugcgaccccacgggcugcaagauguacgcccugcaccagggcaccaccauccgcaacaagcacagcaacgggaccauccacgaccggacggccuuccgcggccugaucuccaccccgcucgggaccccgcccaccgugagcaacuccgacuucaucugcgucggcuggagcuccacgaccugccacgacgggaucggccggaugaccaucugcauccagggcaacaacgacaacgcgaccgccacgguguacuacaaccgccggcugaccaccaccauccgcacgugggcccggaacauccugcgcacccaggagagcgagugcgugugccacaacgggaccugcgccgucgugaugaccgacggcuccgcgagcucccaggccuacacgaaggugauguacuuccacaaggggcucgucaucaaggaggaggcccugaagggcagcgcccggcacaucgaggagugcagcugcuacggccacucccagaaggcgaccugcgugugccgcgacaacuggcagggggccaaccggcccaucaucgagaucgacaugaacacccuggagcacaccagccgcuacgugugcacgggcauccucaccgacaccucccggcccggggacaagagcuccggcgacugcagcaaccccaucaccgggucccccggcgcccccggcgucaagggguucggcuuccugaacggggacaacacguggcugggccgcaccaucagcccccggucccgcagcggguucgagaugcucaagauccccaacgccggcaccgaccccaacucccggaucgccgagcgccaggagaucguggacaacaacaacuggagcggcuacuccgggagcuucaucgacuacuggaacaacgacuccgagugcuacaacccgugcuucuacguggagcugauccggggccgccccgaggaggccaaguacgucugguggaccagcaacucccugaucgcgcucugcgggagccccuuccccgugggcuccgggagcuucccggacggcgcccagauccaguacuucagcuga

SEQ ID NO: 84639 - RNA, 1416 nt, Artificial Sequence
  derived and/or modified sequence opt1 from neuraminidase__InfluenzaA__AGQ81871
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccaucgucgagaacaccuacgugaacaacacgaccaucaucuccaaggagaccgagcugaagacccccagcuaccuccugcugaacaagucccucugcaacguggagggcugggucgugaucgccaaggacaacgccgugcgcuucggggagagcgagcagaucaucgucacgcgggagcccuacguguccugcgaccccaccggcugcaagauguacgcccugcaccagggcaccaccauccgcaacaagcacagcaacgggacgauccacgaccggaccgccuuccgcggccugaucuccaccccgcucgggaccccgcccacggugagcaacuccgacuucaucugcaucggcuggagcuccacgaccugccacgacgggaucggccggaugaccaucugcauccagggcaacaacgacaacgcgaccgccaccgucuacuacaaccgccggcugaccaccacgauccgcaccugggcccggaacauccugcgcacccaggagagcgagugcgugugccacaacgggaccugcgccguggucaugacggacggcuccgcgagcucccaggccuacaccaaggugauguacuuccacaaggggcucgugaucaaggaggaggcccugaagggcagcgcccggcacaucgaggagugcagcugcuacggccacucccagaaggcgaccugcgucugccgcgacaacuggcagggggccaaccggcccaucaucgagaucgacaugaacacccuggagcacacgagccgcuacgugugcaccggcauccucaccgacaccucccggcccggggacaagagcuccggcgacugcagcaaccccaucacggggucccccggcgcccccggcgugaagggguucggcuuccugaacggggacaacaccuggcugggccgcaccaucagcccgcggucccgcagcggguucgagaugcucaagauccccaacgccggcaccgaccccaacucccggaucgccgagcgccaggagaucgucgacaacaacaacuggagcggcuacuccgggagcuucaucgacuacuggaacaacgacuccgagugcuacaaccccugcuucuacguggagcugauccggggccgcccggaggaggccaaguacgugugguggaccagcaacucccugaucgcgcucugcgggagccccuuccccgucggcuccgggagcuuccccgacggcgcccagauccaguacuucagcuga

SEQ ID NO: 84640 - RNA, 1416 nt, Artificial Sequence
  derived and/or modified sequence opt1 from neuraminidase__InfluenzaA__AGQ81872
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccaucgucgagaacaccuacgugaacaacacgaccaucaucuccaaggagaccgagcugaagacccccagcuaccuccugcugaacaagucccucugcaacguggagggcugggucgugaucgccaaggacaacgccgugcgcuucggggagagcgagcagaucaucgucacgcgggagcccuacguguccugcgaccccaccggcugcaagauguacgcccugcaccagggcaccaccauccgcaacaagcacagcaacgggacgauccacgaccggaccgccuuccgcggccugaucuccaccccgcucgggaccccgcccagcguguccaacagcgacuucaucugcgucggcugguccagcacgaccugccacgacgggaucggccggaugaccaucugcauccagggcaacaacgacaacgcgaccgccacgguguacuacaaccgccggcugaccaccaccauccgcacgugggcccggaacauccugcgcacccaggaguccgagugcgugugccacaacgggaccugcgccgucgugaugaccgacggcagcgcguccagccaggccuacacgaaggugauguacuuccacaaggggcucgucaucaaggaggaggcccugaagggcagcgcccggcacaucgaggagugcuccugcuacggccacagccagaaggcgaccugcgugugccgcgacaacuggcagggggccaaccggcccaucaucgagaucgacaugaacacccuggagcacaccucccgcuacgugugcacgggcauccucaccgacaccagccggcccggggacaaguccagcggcgacugcuccaaccccaucaccgggagccccggcgcccccggcgucaagggguucggcuuccugaacggggacaacacguggcugggccgcaccaucuccccgcggagccgcuccggguucgagaugcucaagauccccaacgccggcaccgaccccaacagccggaucgccgagcgccaggagaucguggacaacaacaacugguccggcuacagcggguccuucaucgacuacuggaacaacgacagcgagugcuacaaccccugcuucuacguggagcugauccggggccgcccggaggaggccaaguacgucugguggaccuccaacagccugaucgcgcucugcgggucccccuuccccgugggcagcgggagcuuccccgacggcgcccagauccaguacuucuccuga

SEQ ID NO: 84641 - RNA, 1416 nt, Artificial Sequence
  derived and/or modified sequence opt1 from neuraminidase__InfluenzaA__AGQ81875
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaugaccaucaaccagaacaacaccaccgucguggagaacaccuacgugaacaacaccacgaucaucaccaaggagaccgagcuggagacccccuccuaccuccugcugaacaagggccucugcaacgucgagggguggguggugaucgccaaggacaacgccguccgcuucggcgagacggagcagaucaucgugacccgggagcccuacgugagcugcgaccccaacggcugcaagauguacgcccugcaccaggggaccaccauccgcaacaagcacuccaacggcacgauccacgaccggaccgccuuccgcgggcugaucagcaccccgcucggcaccccgcccacggucuccaacagcgacuucaucugcguggggugguccagcacgaccugccacgacggcaucggccggaugaccaucugcauccaggggaacaacgacaacgcgaccgccaccguguacuacaaccgccggcugaccaccacgaucaagaccugggcccgcaacauccugcggacccaggaguccgagugcgucugccacaacgggaccugcgccguggugaugacggacggcagcgcguccagccaggcccacaccaaggucaucuacuuccacaagggccucaucgugaaggaggaggcccugaagggcuccgcccgccacaucgaggagugcagcugcuacgggcacucccagaaggugaccugcgucugccgggacaacuggcagggcgccaaccgccccaucaucgagaucgacaugaacacccuggagcacacgagccgguacgugugcaccgggauccucaccgacaccagccgccccggcgacaaguccacgggggacugcagcaaccccaucaccggcucccccggcgcgcccggggugaagggcuucggguaccugaacggcgacaacaccuggcuggggcggaccaucagcccgcgcucccggagcggcuucgagaugcucaagauccccaacgccggcaccgaccccaacucccgcaucacggagcggcaggagaucgucgacaacaacaacuggagcggguacuccggcagcuucguggacuacuggaacgacaacuccgagugcuacaaccccugcuucuacgucgagcugauccgcgggcggccggaggaggccaaguacgugugguggaccagcaacuccaucaucgcccugugcggcagccccuuccccgugggguccggcagcuuccccgacggcgcccagauccaguacuucuccuga

SEQ ID NO: 84642 - RNA, 1416 nt, Artificial Sequence
  derived and/or modified sequence opt1 from neuraminidase__InfluenzaA__AGQ81876
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaugaccaucaaccagaacaacaccaccgucguggagaacaccuacgugaacaacaccacgaucaucaccaaggagaccgagcuggagacccccuccuaccuccugcugaacaagggccucugcaacgucgagggguggguggugaucgccaaggacaacgccguccgcuucggcgagacggagcagaucaucgugacccgggagcccuacgugagcugcgaccccaacggcugcaagauguacgcccugcaccaggggaccaccauccgcaacaagcacuccaacggcacgauccacgaccggaccgccuuccgcgggcugaucagcaccccgcucggcaccccgcccacggucuccaacagcgacuucaucugcguggggugguccagcacgaccugccacgacggcaucggccggaugaccaucugcauccagggggacaacgacaacgcgaccgccaccguguacuacaaccgccggcugaccaccacgaucaagaccugggcccgcaacauccugcggacccaggaguccgagugcgucugccacaacgggaccugcgccguggugaugacggacggcagcgcguccagccaggcccacaccaaggucaucuacuuccacaagggccucaucgugaaggaggaggcccugaagggcuccgcccgccacaucgaggagugcagcugcuacgggcacucccagaaggugaccugcgucugccgggacaacuggcagggcgccaaccgccccaucaucgagaucgacaugaacacccuggagcacacgagccgguacgugugcaccgggauccucaccgacaccagccgccccggcgacaaguccacgggggacugcagcaaccccaucaccggcucccccggcgcgcccggggugaagggcuucggguaccugaacggcgacaacaccuggcuggggcggaccaucagcccgcgcucccggagcggcuucgagaugcucaagauccccaacgccggcaccgaccccaacucccgcaucacggagcggcaggagaucgucgacaacaacaacuggagcggguacuccggcagcuucguggacuacuggaacgacaacuccgagugcuacaaccccugcuucuacgucgagcugauccgcgggcggccggaggaggccaaguacgugugguggaccagcaacuccaucaucgcccugugcggcagccccuuccccgugggguccggcagcuuccccgacggcgcccagauccaguacuucuccuga

SEQ ID NO: 84643 - RNA, 1416 nt, Artificial Sequence
  derived and/or modified sequence opt1 from neuraminidase__InfluenzaA__AGQ81877
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaacagcacgugcaccaccaucaaccagaacaacaccaccgucguggagaacaccuacgugaacaacacgaccaucaucaccaaggagaccgagcugaagacgcccuccuaccuccugcugaacaagagccucugcaacgucgagggcuggguggugaucgccaaggacaacgccguccgcuucggggaguccgagcagaucaucgugacccgggagcccuacgugagcugcgaccccaccggcugcaagauguacgcccugcaccagggcaccacgauccgcaacaagcacuccaacgggaccauccacgaccggaccgccuuccgcggccugaucagcaccucccucgggacgccgcccaccaucagcaacuccgacuucaugugcgucggcuggagcuccacgaccugccacgacgggaucggccggaugaccaucugcauccagggcaacaacgacaacgcgaccgccaccguguacuacaaccgccggcugaccacgaccaucaagaccugggcccgcaacauccugcggacccaggagagcgagugcgugugccacaacgggaucugcgccgucgugaugacggacggcuccgcgagcucccaggccuacaccaaggugauguacuuccacaaggggcucgucgugaaggaggaggcccugaagggcagcgcccgccacaucgaggagugcagcugcuacggccacucccagaaggugaccugcgucugccgggacaacuggcagggggccaaccgccccaucaucgagaucgacaugaacacccuggagcacacgagccgguacgugugcaccggcauccucaccgacaccucccgccccggggacaagagcuccggcgacugcagcaacccgaucacggggucccccggcgcgcccggcgugaagggguucggcuuccugaacggggacaacaccuggcugggccggaccaucagcccccgcucccggagcggguucgagaugcucaagaucccgaacgccggcaccgaccccaacucccgcaucgccggccggcaggagaucgucgacaacaacaacuggagcggguacuccggcagcuucaucgacuacuggaacgacaacuccgagugcuacaaccccugcuucuacguggagcugauccgcgggcggcccgaggaggccaaguacgucugguggaccagcaacucccugaucgcccucugcggcagcccguuccccgugggguccggcagcuuccccgacggcgcgcagauccaguacuucagcuga

SEQ ID NO: 84644 - RNA, 1416 nt, Artificial Sequence
  derived and/or modified sequence opt1 from neuraminidase__InfluenzaA__AGQ81878
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaaccugaccugcaccacgaucaaccagaacaacaccaccgucguggagaacaccuacgugaacaacacgaccaucaucaccaaggagaccgaccucaaggcccccagcuaccugcugcucaacaagucccugugcaacgucgagggcuggguggugaucgccaaggacaacgccguccgcuucggggagagcgagcagaucaucgugacgcgggagcccuacguguccugcgaccccaccggcugcaagauguacgcccugcaccagggcaccaccauccgcaacaagcacagcaacgggacgauccacgaccggaccgcguuccgcggccucaucuccaccccgcuggggaccccgcccacggucagcaacuccgacuucaugugcgugggcuggagcuccacgaccugccacgacgggaucggccggaugaccaucugcauccagggcaacaacgacaacgccaccgccaccguguacuacaaccgccggcugaccaccacgaucaagaccugggcccgcaacauccuccggacccaggagagcgagugcgucugccacaacgggaccugcgcgguggugaugacggacggcuccgccagcucccaggccuacaccaaggucauguacuuccacaaggggcugguggugaaggaggaggcccugaagggcagcgcccgccacaucgaggagugcuccugcuacggccacagccagaaggugaccugcgucugccgggacaacuggcagggggcgaaccgccccaucaucgagaucgacaugaacacccucgagcacacgagccgguacgugugcaccggcauccugaccgacaccucccgccccggggacaagagcuccggcgacugcagcaaccccaucacggggucccccggcgcccccggcgucaagggguucggcuuccugaacggggacaacaccuggcucggccggaccaucagcccgcgcucccggagcggguucgagaugcugaagauccccaacgccggcaccgaccccaacucccgcaucgccgagcggcaggagaucguggacaacaacaacuggagcggcuacuccgggagcuucaucgacuacuggaacgacaacuccgagugcuacaaccccugcuucuacgucgagcugauccgcggccggccggaggaggccaaguacgugugguggaccagcaacucccucaucgcgcugugcgggagccccuuccccaucggcuccgggagcuuccccgacggcgcccagauccaguacuucuccuga

SEQ ID NO: 84645 - RNA, 1416 nt, Artificial Sequence
  derived and/or modified sequence opt1 from neuraminidase__InfluenzaA__AGQ81882
augaaccccaaccagaagcuguucgcccucagcggcguggccaucgcgcuguccguccugaaccuccugaucgggaucagcaacgugggccugaacgugucccuccaccugaaggagaagggggccaagcaggaggagaaccugaccugcaccacgaucaaccagaacaacaccaccgucguggagaacaccuacgugaacaacacgaccgucaucaccaaggaggccgacuggaagaccccgagcuaccuccugcugaacaagucccucugcaacguggagggcuggguggucaucgccaaggacaacgccauccgcuucggggagagcgagcagaucaucgugacgcgggagcccuacguguccugcgaccccaccggcugcaagauguacgcgcugcaccagggcaccaccauccgcaacaagcacagcaacgggacgauccacgaccggaccgccuuccgcggccugaucuccacgccccucgggaccccgcccaccgucagcaacuccgacuucaugugcgugggcuggagcuccacgaccugccacgacgggaucggccggaugaccaucugcauccagggcaacaacgacaacgccaccgccaccguguacuacaacgggcgccugaccaccacgaucaagaccugggcgcggaacauccugcgcacccaggagagcgagugcgucugccacaacgggaccugcgccguggugaugacggacggcuccgccagcucccaggccuacaccaaggucauguacuuccacaagggccucgugaucaaggaggaggcccugaagggcagcgcgcggcacaucgaggagugcuccugcuacgggcacagccagaaggugaccugcgucugccgcgacaacuggcagggcgccaaccggcccaucaucgagaucgacaugaacacccuggagcacacgagccgcuacgugugcaccgggauccucaccgacaccucccggcccggcgacaagagcuccggggacugcagcaacccgaucacgggcucccccggcgcccccggggugaagggcuucggguuccugaacggcgacaacaccuggcuggggcgcaccaucagcccccggucccgcagcggcuucgagaugcucaagaucccgaacgccggcaucgaccccaacucccggaucgccgagcgccaggagaucgucgacaacaacaacuggagcggguacuccggcagcuucaucgacuacuggaacgacaacuccgagugcuacaaccccugcuucuacguggagcugauccgggggcgccccgaggaggcgaaguacgucugguggaccagcaacucccugaucgcccucugcggcagcccguuccccgugggguccggcagcuuccccgacggcgcccagauccaguacuucuccuga

SEQ ID NO: 84646 - RNA, 1416 nt, Artificial Sequence
  derived and/or modified sequence opt1 from neuraminidase__InfluenzaA__AGQ81883
augaaccccaaccagaagcuguucgcccucagcggcguggccaucgcgcuguccguccugaaccuccugaucgggaucagcaacgugggccugaacgugucccuccaccugaaggagaaggggccgaagcaggaggagaaccugaccugcaccacgaucaaccagaacaacaccaccgucguggagaacaccuacgugaacaacacgaccgucaucaccaaggaggccgacuggaagacccccagcuaccuccugcugaacaagucccucugcaacguggagggcuggguggucaucgccaaggacaacgccauccgcuucggggagagcgagcagaucaucgugacgcgggagcccuacguguccugcgaccccaccggcugcaagauguacgcccugcaccagggcaccaccauccgcaacaagcacagcaacgggacgauccacgaccggaccgcguuccgcggccugaucuccaccccgcucgggaccccgcccacggucagcaacuccgacuucaugugcgugggcuggagcuccacgaccugccacgacgggaucggccggaugaccaucugcauccagggcaacaacgacaacgccaccgccaccguguacuacaacgggcgccugaccaccacgaucaagaccugggcccggaacauccugcgcacccaggagagcgagugcgucugccacaacgggaccugcgcgguggugaugacggacggcuccgccagcucccaggccuacaccaaggucauguacuuccacaagggccucgugaucaaggaggaggcccugaagggcagcgcccggcacaucgaggagugcuccugcuacgggcacagccagaaggugaccugcgucugccgcgacaacuggcagggcgcgaaccggcccaucaucgagaucgacaugaacacccuggagcacacgagccgcuacgugugcaccgggauccucaccgacaccucccggcccggcgacaagagcuccggggacugcagcaaccccaucacgggcucccccggcgcccccggggugaagggcuucggguuccugaacggcgacaacaccuggcuggggcgcaccaucagcccgcggucccgcagcggcuucgagaugcucaagauccccaacgccggcaucgaccccaacucccggaucgccgagcgccaggagaucgucgacaacaacaacuggagcggguacuccggcagcuucaucgacuacuggaacgacaacuccgagugcuacaaccccugcuucuacguggagcugauccgggggcgcccggaggaggccaaguacgucugguggaccagcaacucccugaucgcgcucugcggcagccccuuccccgugggguccggcagcuuccccgacggcgcccagauccaguacuucuccuga

SEQ ID NO: 84647 - RNA, 1416 nt, Artificial Sequence; identical to SEQ ID NO: 84646
  derived and/or modified sequence opt1 from neuraminidase__InfluenzaA__AGQ81884

SEQ ID NO: 84648 - RNA, 1416 nt, Artificial Sequence; identical to SEQ ID NO: 84646
  derived and/or modified sequence opt1 from neuraminidase__InfluenzaA__AGQ81885

SEQ ID NO: 84649 - RNA, 1416 nt, Artificial Sequence; identical to SEQ ID NO: 84646
  derived and/or modified sequence opt1 from neuraminidase__InfluenzaA__AGQ81886

SEQ ID NO: 84650 - RNA, 1356 nt, Artificial Sequence
  derived and/or modified sequence opt1 from neuraminidase__InfluenzaA__AGQ81888
augaaccccaaccagaagcuguucgcccucagcggcguggccaucgcgcuguccguccugaaccuccugaucgggcugagcaacgugggccucaacgugucccugcaccugaaggaggccgggccgaagcaggaggagaaccugaccugcaugaccacgaaggagaccgagcucggcacccccagcuaccugcuccugaacaagucccugugcaacgucgagggguggguggugaucgccaaggacaacgccguccgcuucggcgagagcgagcagaucaucaucacccgggagcccuacguguccugcgaccccaacggcugcaagauguacgcccuccaccaggggacgaccauccgcaacaagcacagcaacggcaccauccacgaccggaccgcguuccgcgggcugaucuccacgccgcugggcaccccgcccaccgugagcaacuccgacuucaucugcgucggguggagcuccaccacgugccacgacggcaucggccggaugaccaucugcauccaggggaacaacgacaacgccaccgccaccguguacuacaaccgccggcucacgaccaccaucaagaccugggcccgcaacauccugcggacgcaggagagcgagugcgugugccacaacgggaccugcgcggucgugaugaccgacggcuccgccagcucccaggcccacaccaaggugauguacuuccacaagggccuggucgugaaggaggaggcccucaagggcagcgccaagcacaucgaggagugcuccugcuacgggcacaaccagaaggugacgugcgucugccgcgacaacuggcagggcgcgaaccggcccaucaucgagaucgacaugaacacccuggagcacaccagccgcuacgugugcaccgggauccugacggacaccagccggcccggcgacaagcccaccggggacugcuccaaccccaucaccggcagccccggcgccccgggggugaagggcuucggguuccucaacggcgacaacacguggcuggggcgcaccaucagcccccggucccgcuccggcuucgagaugcugaagauccccaacgccggcaucgaccccaacagccggaucgccgagcgccaggagaucgucgacaacuccaacuggagcggguacuccggcagcuucaucgacuacuggaacgacaacuccgagugcuacaacccgugcuucuacguggagcucauccgggggcgccccgaggaggccaaguacgugugguggaccagcaacucccugaucgcgcugugcggcagccccuuccccgucggguccggcagcuucccggacggcgcccagauccaguacuucuccuga

SEQ ID NO: 84651 - RNA, 1356 nt, Artificial Sequence
  derived and/or modified sequence opt1 from neuraminidase__InfluenzaA__AGQ81889
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcucccaggcccacacgaaggugauguacuuccacaagggccuggucgugaaggaggaggcccucaagggcagcgccaagcacaucgaggagugcuccugcuacgggcacaaccagaaggugaccugcgucugccgcgacaacuggcagggcgccaaccggcccaucaucgagaucgacaugaacacccuggagcacaccagccgcuacgugugcacggggauccugaccgacaccagccggcccggcgacaagcccaccggggacugcuccaaccccaucacgggcagccccggcgcgccgggggugaagggcuucggguuccucaacggcgacaacaccuggcuggggcgcaccaucagcccccggucccgcuccggcuucgagaugcugaagauccccaacgccggcaucgaccccaacagccggaucgccgagcgccaggagaucgucgacaacuccaacuggagcggguacuccggcagcuucaucgacuacuggaacgacaacuccgagugcuacaacccgugcuucuacguggagcucauccgggggcgccccgaggaggccaaguacgugugguggaccagcaacucccugaucgcccugugcggcagccccuuccccgucggguccggcagcuucccggacggcgcgcagauccaguacuucuccuga

SEQ ID NO: 84652 - RNA, 1356 nt, Artificial Sequence; identical to SEQ ID NO: 84651
  derived and/or modified sequence opt1 from neuraminidase__InfluenzaA__AGQ81890

SEQ ID NO: 84653 - RNA, 1356 nt, Artificial Sequence; identical to SEQ ID NO: 84651
  derived and/or modified sequence opt1 from neuraminidase__InfluenzaA__AGQ81891

SEQ ID NO: 84654 - RNA, 1356 nt, Artificial Sequence
  derived and/or modified sequence opt1 from neuraminidase__InfluenzaA__AGQ81893
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcucccaggcccacacgaaggugauguacuuccacaagggccuggucgugaaggaggaggcccucaagggcagcgccaagcacaucgaggagugcuccugcuacgggcacaaccagaaggugaccugcgucugccgcgacaacuggcagggcgccaaccggcccaucaucgagaucgacaugaacacccuggagcacaccagccgcuacgugugcacggggauccugaccgacaccagccggcccggcgacaagcccaccggggacugcuccaaccccaucacgggcagccccggcgcgccgggggugaagggcuucggguuccucaacggcgacaacaccuggcuggggcgcaccaucagcccccggucccgcuccggcuucgagaugcugaagauccccaacgccggcaucgaccccaacagccggaucgccgagcgccaggagaucgucgacaacuccaacuggagcggguacuccggcagcuucaucgacuacuggaacgacaacuccgagugcuacaacccgugcuucuacguggagcucauccgggggcgccccgaggaggccgaguacgugugguggaccagcaacucccugaucgcccugugcggcagccccuuccccgucggguccggcagcuucccggacggcgcgcagauccaguacuucuccuga

SEQ ID NO: 84655 - RNA, 1356 nt, Artificial Sequence; identical to SEQ ID NO: 84651
  derived and/or modified sequence opt1 from neuraminidase__InfluenzaA__AGQ81894

SEQ ID NO: 84656 - RNA, 1356 nt, Artificial Sequence; identical to SEQ ID NO: 84651
  derived and/or modified sequence opt1 from neuraminidase__InfluenzaA__AGQ81895

SEQ ID NO: 84657 - RNA, 1356 nt, Artificial Sequence; identical to SEQ ID NO: 84651
  derived and/or modified sequence opt1 from neuraminidase__InfluenzaA__AGQ81896

SEQ ID NO: 84658 - RNA, 1356 nt, Artificial Sequence; identical to SEQ ID NO: 84651
  derived and/or modified sequence opt1 from neuraminidase__InfluenzaA__AGQ81897

SEQ ID NO: 84659 - RNA, 1356 nt, Artificial Sequence; identical to SEQ ID NO: 84651
  derived and/or modified sequence opt1 from neuraminidase__InfluenzaA__AGQ81898

SEQ ID NO: 84660 - RNA, 1356 nt, Artificial Sequence; identical to SEQ ID NO: 84651
  derived and/or modified sequence opt1 from neuraminidase__InfluenzaA__AGQ81899

SEQ ID NO: 84661 - RNA, 1356 nt, Artificial Sequence; identical to SEQ ID NO: 84651
  derived and/or modified sequence opt1 from neuraminidase__InfluenzaA__AGQ81900

SEQ ID NO: 84662 - RNA, 1356 nt, Artificial Sequence; identical to SEQ ID NO: 84651
  derived and/or modified sequence opt1 from neuraminidase__InfluenzaA__AGQ81901

SEQ ID NO: 84663 - RNA, 1356 nt, Artificial Sequence; identical to SEQ ID NO: 84651
  derived and/or modified sequence opt1 from neuraminidase__InfluenzaA__AGQ81902

SEQ ID NO: 84664 - RNA, 1356 nt, Artificial Sequence; identical to SEQ ID NO: 84651
  derived and/or modified sequence opt1 from neuraminidase__InfluenzaA__AGQ81903

SEQ ID NO: 84665 - RNA, 1356 nt, Artificial Sequence
  derived and/or modified sequence opt1 from neuraminidase__InfluenzaA__AGQ81904
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcucccaggcccacacgaaggugauguacuuccacaagggccuggucgugaaggaggaggcccucaagggcagcgccaagcacaucgaggagugcuccugcuacgggcacaaccagaaggugaccugcgucugccgcgacaacuggcagggcgccaaccggcccaucaucgagaucgacaugaacacccuggagcacaccagccgcuacgugugcacggggauccugaccgacaccagccggcccggcgacaagcccaccggggacugcuccaaccccaucacgggcagccccggcgcgccgggggugaagggcuucggguuccucaacggcgacaacaccuggcuggggcgcaccaucagcccccggucccgcuccggcuucgagaugcugaagauccccaacgccggcaucgaccccaacagccggaucaccgagcgccaggagaucgucgacaacuccaacuggagcggguacuccggcagcuucaucgacuacuggaacgacaacuccgagugcuacaacccgugcuucuacguggagcucauccgggggcgccccgaggaggccaaguacgugugguggacgagcaacucccugaucgcccugugcggcagccccuuccccgucggguccggcagcuucccggacggcgcccagauccaguacuucuccuga

SEQ ID NO: 84666 - RNA, 1356 nt, Artificial Sequence; identical to SEQ ID NO: 84651
  derived and/or modified sequence opt1 from neuraminidase__InfluenzaA__AGQ81905

SEQ ID NO: 84667 - RNA, 1356 nt, Artificial Sequence
  derived and/or modified sequence opt1 from neuraminidase__InfluenzaA__AGQ81906
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcucccaggcccacacgaaggugauguacuuccacaagggccuggucgugaaggaggaggcccucaagggcagcgcccgccacaucgaggagugcuccugcuacgggcacaaccagaaggugaccugcgucugccgggacaacuggcagggcgccaaccgccccaucaucgagaucgacaugaacacccuggagcacaccagccgguacgugugcacggggauccugaccgacaccagccgccccggcgacaagcccaccggggacugcuccaaccccaucacgggcagccccggcgcgccgggggugaagggcuucggguuccucaacggcgacaacaccuggcuggggcggaccaucagcccccgcucccgguccggcuucgagaugcugaagauccccaacgccggcaucgaccccaacagccgcaucgccgagcggcaggagaucgucgacaacuccaacuggagcggguacuccggcagcuucaucgacuacuggaacgacaacuccgagugcuacaacccgugcuucuacguggagcucauccgcgggcggcccgaggaggccaaguacgugugguggaccagcaacucccugaucgcccugugcggcagccccuuccccgucggguccggcagcuucccggacggcgcgcagauccaguacuucuccuga

SEQ ID NO: 84668 - RNA, 1356 nt, Artificial Sequence; identical to SEQ ID NO: 84651
  derived and/or modified sequence opt1 from neuraminidase__InfluenzaA__AGQ81907

SEQ ID NO: 84669 - RNA, 1356 nt, Artificial Sequence
  derived and/or modified sequence opt1 from neuraminidase__InfluenzaA__AGQ81908
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcaaccaggcccacacgaaggugauguacuuccacaagggccuggucgugaaggaggaggcccucaagggcuccgccaagcacaucgaggagugcagcugcuacgggcacaaccagaaggugaccugcgucugccgcgacaacuggcagggcgccaaccggcccaucaucgagaucgacaugaacacccuggagcacaccucccgcuacgugugcacggggauccugaccgacaccagccggcccggcgacaagcccaccggggacugcagcaaccccaucacgggcucccccggcgcgccgggggugaagggcuucggguuccucaacggcgacaacaccuggcuggggcgcaccaucagcccccggucccgcagcggcuucgagaugcugaagauccccaacgccggcaucgaccccaacucccggaucaccgagcgccaggagaucgucgacaacagcaacugguccggguacagcggcuccuucaucgacuacuggaacgacaacagcgagugcuacaacccgugcuucuacguggagcucauccgggggcgccccgaggaggccaaguacgugugguggacguccaacagccugaucgcccugugcggcucccccuuccccgucgggagcggcuccuucccggacggcgcccagauccaguacuucagcuga

SEQ ID NO: 84670 - RNA, 1356 nt, Artificial Sequence; identical to SEQ ID NO: 84651
  derived and/or modified sequence opt1 from neuraminidase__InfluenzaA__AGQ81909

SEQ ID NO: 84671 - RNA, 1356 nt, Artificial Sequence
  derived and/or modified sequence opt1 from neuraminidase__InfluenzaA__AGQ81910
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcggccaggcccacacgaaggugauguacuuccacaagggccuggucgugaaggaggaggcccucaagggguccgccaagcacaucgaggagugcagcugcuacggccacaaccagaaggugaccugcgucugccgcgacaacuggcagggggccaaccggcccaucaucgagaucgacaugaacacccuggagcacaccuccagcuacgugugcacgggcauccugaccgacaccagccgccccggggacaagcccaccggcgacugcuccaaccccaucacgggcagccccggggcgccgggcgugaagggguucggcuuccucaacggggacaacaccuggcugggccggaccaucagcccccgcucccgguccggcuucgagaugcugaagauccccaacgccgggaucgaccccaacagccgcaucgccgagcggcaggagaucgucgacaacuccaacuggagcggcuacuccgggagcuucaucgacuacuggaacgacaacuccgagugcuacaacccgugcuucuacguggagcucauccgcggccggcccgaggaggccaaguacgugugguggaccagcaacucccugaucgcccugugcgggagccccuuccccgucggcuccggcagcuucccggacggggcgcagauccaguacuucuccuga

SEQ ID NO: 84672 - RNA, 1356 nt, Artificial Sequence
  derived and/or modified sequence opt1 from neuraminidase__InfluenzaA__AGQ81911
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcggccaggcccacacgaaggugauguacuuccacaagggccuggucgugaaggaggaggcccucaagggguccgccaagcacaucgaggagugcagcugcuacggccacaaccagaacgugaccugcgucugccgcgacaacuggcagggggccaaccggcccaucaucgagaucgacaugaacacccuggagcacaccucccgcuacgugugcacgggcauccugaccgacaccagccggcccggggacaagcccaccggcgacugcagcaaccccaucacgggcucccccggggcgccgggcgugaagggguucggcuuccucaacggggacaacaccuggcugggccgcaccaucagcccccggucccgcagcggcuucgagaugcugaagauccccaacgccgggaucgaccccaacucccggaucgccgagcgccaggagaucgucgacaacagcaacugguccggcuacagcggguccuucaucgacuacuggaacgacaacagcgagugcuacaacccgugcuucuacguggagcucauccggggccgccccgaggaggccaaguacgugugguggaccuccaacagccugaucgcccugugcgggucccccuuccccgucggcagcggcuccuucccggacggggcgcagauccaguacuucagcuga

SEQ ID NO: 84673 - RNA, 1356 nt, Artificial Sequence; identical to SEQ ID NO: 84651
  derived and/or modified sequence opt1 from neuraminidase__InfluenzaA__AGQ81912

SEQ ID NO: 84674 - RNA, 1356 nt, Artificial Sequence
  derived and/or modified sequence opt1 from neuraminidase__InfluenzaA__AGQ81913
augaaccccaaccagaagcuguucgcccucagcggcguggccaucacccuguccguccugaaccuccugaucgggcugagcaacgugggccucaacgugucccugcaccugaaggagaccgggccgaagcaggaggagaaccucacgugcaugaccaccaaggagaccgagcugggcacgcccagcuaccugcuccugaacaagucccugugcaacgucgagggguggguggugaucgcgaaggacaacgccguccgcuucggcgagagcgagcagaucaucaucacccgggagcccuacguguccugcgaccccaacggcugcaagauguacgcccuccaccaggggaccaccauccgcaacaagcacagcaacggcacgauccacgaccggaccgccuuccgcgggcugaucuccaccccgcugggcaccccgcccacggugagcaacuccgacuucaucugcgucggguggagcuccacgaccugccacgacggcaucggccggaugaccaucugcauccaggggaacaacgacaacgccaccgcgaccguguacuacaaccgccggcucaccaccacgaucaagaccugggcccgcaacauccugcggacccaggagagcgagugcgugugccacaacgggaccugcgccgucgugaugacggacggcuccgccagcggccaggcgcacaccaaggugauguacuuccacaagggccuggucgugaaggaggaggcccucaagggguccgccaagcacaucgaggagugcagcugcuacggccacaaccagaaggugaccugcgucugccgcgacaacuggcagggggccaaccggcccaucaucgagaucgacaugaacacccuggagcacacgucccgcuacgugugcaccggcauccugaccgacaccagccggcccggggacaagcccacgggcgacugcagcaaccccaucaccggcucccccggggccccgggcgugaagggguucggcuuccucaacggggacaacaccuggcugggccgcaccaucagcccccggucccgcagcggcuucgagaugcugaagauccccaacgcggggaucgaccccaacucccggaucgccgagcgccaggagaucgucgacaacagcaacugguccggcuacagcggguccuucaucgacuacuggaacgacaacagcgagugcuacaacccgugcuucuacguggagcucauccggggccgccccgaggaggccaaguacgugugguggacguccaacagccugaucgcccugugcgggucccccuuccccgucggcagcggcuccuucccggacggggcccagauccaguacuucagcuga

SEQ ID NO: 84675 - RNA, 1356 nt, Artificial Sequence; identical to SEQ ID NO: 84651
  derived and/or modified sequence opt1 from neuraminidase__InfluenzaA__AGQ81914

SEQ ID NO: 84676 - RNA, 1356 nt, Artificial Sequence; identical to SEQ ID NO: 84651
  derived and/or modified sequence opt1 from neuraminidase__InfluenzaA__AGQ81915

SEQ ID NO: 84677 - RNA, 1416 nt, Artificial Sequence
  derived and/or modified sequence opt1 from neuraminidase__InfluenzaA__AGQ81917
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaucaaccagaacaacaccaccgucguggagaacaccuacgugaacaacacgaccaucaucaccaaggagaccgagcucgagacgcccaacuaccugcuccugaacaagagccugugcaacgucgagggcugggugguggucgccaaggacaacgccgugcgcuucggggaguccgagcagaucaucgugacccgggagcccuacgucagcugcgaccccaacggcugcaagauguacgcccuccaccagggcaccaccauccgcaacaagcacuccaacgggacgauccacgaccggaccgccuuccgcggccugaucagcaccccgcuggggaccccgcccacgguguccaacagcgacuucaucugcgugggcugguccagcacgaccugccacgacgggaucggccggaugaccaucugcauccagggcaacaacgacaacgcgaccgccaccgucuacuacaaccgccggcucaccaccacgaucaagaccugggcccgcaacauccugcggacccaggaguccgagugcgugugccacaacgggaccugcgccguggucaugacggacggcagcgcguccagccaggcccacaccaaggugauguacuuccacaaggggcuggugaucaaggaggaggcccucaagggcuccgccaagcacaucgaggagugcagcugcuacggccacaaccagaaggugaccugcgucugccgcgacaacuggcagggggccaaccggcccaucaucgagaucgacaugaacacccuggagcacacgucccgcuacgugugcaccggcauccugaccgacaccagccggcccggggacaagcccacgggcgacugcagcaaccccaucaccgggucccccggcgcgccgggcgucaagggguucggcuuccucaacggggacaacaccuggcugggccgcaccaucagcccccggucccgcagcggguucgagaugcugaagauccccaacgccggcaucgaccccaacucccggaucgccgagcgccaggagaucguggacaacagcaacugguccggcuacagcggguccuucaucgacuacuggaacgacaacagcgagugcuacaacccgugcuucuacgucgagcucauccggggccgccccgaggaggccaaguacgugugguggaccuccaacagccugaucgcccugugcgggucccccuuccccgugggcagcggguccuucccggacggcgcgcagauccaguacuucagcuga

SEQ ID NO: 84678 - RNA, 1356 nt, Artificial Sequence
  derived and/or modified sequence opt1 from neuraminidase__InfluenzaA__AGQ81918
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaaggggcugugcaacgucgagggcuggguggugaucgccaaggacaacgccguccgcuucggcgaguccgagcagaucaucaucacgcgggagcccuacgugagcugcgaccccaacgggugcaagauguacgcccuccaccagggcaccaccauccgcaacaagcacuccaacgggaccauccacgaccggacggccuuccgcggccugaucagcaccccgcuggggaccccgcccaccguguccaacagcgacuucaucugcgucggcugguccagcacgaccugccacgacggcaucgggcggaugaccaucugcauccagggcaacaacgacaacgcgaccgccacgguguacuacaaccgccggcucaccaccaccaucaagacgugggcccgcaacauccugcggacccaggaguccgagugcgugugccacaacgggaccugcgccgucgugaugaccgacggcagcgcguccagccaggcccacacgaaggugauguacuuccacaagggccuggucgugaaggaggaggcccucaagggguccgccaagcacaucgaggagugcagcugcuacggccacaaccagaaggugaccugcgucugccgcgacaacuggcagggggccaaccggcccaucaucgagaucgacaugaacacccuggagcacaccucccgcuacgugugcacgggcauccugaccgacaccagccggcccggggacaagcccaccggcgacugcagcaaccccaucacgggcucccccggggcgccgggcgugaagggguucggcuuccucaacggggacaacaccuggcugggccgcaccaucagcccccggucccgcagcggcuucgagaugcugaagauccccaacgccgggaucgaccccaacucccggaucgccgagcgccaggagaucgucgacaacagcaacugguccggcuacagcggguccuucaucgacuacuggaacgacaacagcgagugcuacaacccgugcuucuacguggagcucauccggggccgccccgaggaggccaaguacgugugguggaccuccaacagccugaucgcccugugcgggucccccuuccccgucggcagcggcuccuucccggacggggcgcagauccaguacuucagcuga

SEQ ID NO: 84679 - RNA, 1356 nt, Artificial Sequence; identical to SEQ ID NO: 84651
  derived and/or modified sequence opt1 from neuraminidase__InfluenzaA__AGQ81919

SEQ ID NO: 84680 - RNA, 1356 nt, Artificial Sequence; identical to SEQ ID NO: 84651
  derived and/or modified sequence opt1 from neuraminidase__InfluenzaA__AGQ81920

SEQ ID NO: 84681 - RNA, 1356 nt, Artificial Sequence
  derived and/or modified sequence opt1 from neuraminidase__InfluenzaA__AGQ81921
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgagcggccaggcccacacgaaggugauguacuuccacaagggccuggucgugaaggaggaggcccucaagggguccgccaagcacaucgaggagugcagcugcuacggccacaaccagaaggugaccugcgucugccgcgacaacuggcagggggccaaccggcccaucaucgagaucgacaugaacacccuggagcacaccucccgcuacgugugcacgggcauccugaccgacaccagccggcccggggacaagcccaccggcgacugcagcaaccccaucacgggcucccccggggcgccgggcgugaagggguucggcuuccucaacggggacaacaccuggcugggccgcaccaucagcccccggucccgcagcggcuucgagaugcugaagauccccaacgccgggaucgaccccaacucccggaucgccgagcgccaggagaucgucgacaacagcaacugguccggcuacagcggguccuucaucgacuacuggaacgacaacagcgagugcuacaacccgugcuucuacguggagcucauccggggccgccccgaggaggccaaguacgugugguggaccuccaacagccugaucgcccugugcgggucccccuuccccgucggcagcggcuccuucccggacggggcgcagauccaguacuucagcuga

SEQ ID NO: 84682 - RNA, 1356 nt, Artificial Sequence; identical to SEQ ID NO: 84651
  derived and/or modified sequence opt1 from neuraminidase__InfluenzaA__AGQ81922

SEQ ID NO: 84683 - RNA, 1356 nt, Artificial Sequence; identical to SEQ ID NO: 84681
  derived and/or modified sequence opt1 from neuraminidase__InfluenzaA__AGQ81923

SEQ ID NO: 84684 - RNA, 1356 nt, Artificial Sequence
  derived and/or modified sequence opt1 from neuraminidase__InfluenzaA__AGQ81924
augaaccccaaccagaagcuguucgcccucagcggcguggccaucgcgcuguccguccugaaccuccugaucgggcugagcaacgugggccucaacgugucccugcaccugaaggagaccgggccgaagcaggaggagaaccugaccugcaugacgaccaaggagaccgagcucggcacccccagcuaccugcuccugaacaagucccugugcaacgucgagggguggguggugaucgccaaggacaacgccguccgcuucggcgagagcgagcagaucaucaucacgcgggagcccuacguguccugcgaccccaacggcugcaagauguacgcccuccaccaggggaccaccauccgcaacaagcacagcaacggcaccauccacgaccggacggccuuccgcgggcugaucuccaccccgcugggcaccccgcccaccgugagcaacuccgacuucaucugcgucggguggagcuccacgaccugccacgacggcaucggccggaugaccaucugcauccaggggaacaacgacaacgcgaccgccacgguguacuacaaccgccggcucaccaccaccaucaagacgugggcccgcaacauccugcggacccaggagagcgagugcgugugccacaacgggaccugcgccgucgugaugaccgacggcuccgcgaacagccaggcccacacgaaggugauguacuuccacaagggccuggucgugaaggaggaggcccucaagggcuccgccaagcacaucgaggagugcagcugcuacgggcacaaccagaaggugaccugcgucugccgcgacaacuggcagggcgccaaccggcccaucaucgagaucgacaugaacacccuggagcacaccucccgcuacgugugcacggggauccugaccgacaccagccggcccggcgacaagcccaccggggacugcagcaaccccaucacgggcucccccggcgcgccgggggugaagggcuucggguuccucaacggcgacaacaccuggcuggggcgcaccaucagcccccggucccgcagcggcuucgagaugcugaagauccccaacgccggcaucgaccccaacucccggaucgccgagcgccaggagaucgucgacaacagcaacugguccggguacagcggcuccuucaucgacuacuggaacgacaacagcgagugcuacaacccgugcuucuacguggagcucauccgggggcgccccgaggaggccaaguacgugugguggaccuccaacagccugaucgcccugugcggcucccccuuccccgucgggagcggcuccuucccggacggcgcgcagauccaguacuucagcuga

SEQ ID NO: 84685 - RNA, 1356 nt, Artificial Sequence; identical to SEQ ID NO: 84651
  derived and/or modified sequence opt1 from neuraminidase__InfluenzaA__AGQ81925

SEQ ID NO: 84686 - RNA, 1356 nt, Artificial Sequence; identical to SEQ ID NO: 84651
  derived and/or modified sequence opt1 from neuraminidase__InfluenzaA__AGQ81926

SEQ ID NO: 84687 - RNA, 1356 nt, Artificial Sequence; identical to SEQ ID NO: 84651
  derived and/or modified sequence opt1 from neuraminidase__InfluenzaA__AGQ81927

SEQ ID NO: 84688 - RNA, 1356 nt, Artificial Sequence; identical to SEQ ID NO: 84651
  derived and/or modified sequence opt1 from neuraminidase__InfluenzaA__AGQ81928

SEQ ID NO: 84689 - RNA, 1356 nt, Artificial Sequence; identical to SEQ ID NO: 84651
  derived and/or modified sequence opt1 from neuraminidase__InfluenzaA__AGQ81929

SEQ ID NO: 84690 - RNA, 1413 nt, Artificial Sequence
  derived and/or modified sequence opt1 from neuraminidase__InfluenzaA__AGQ81930
augaaccccaaccagaagaucaucaccaucggcagcaucucccuggggcucguggucuucaacgugcugcugcacguggucagcaucaucgugaccgugcucguccugggccgcgggggcaacuccgggaucugcaacgagacgguggugcgggaguacaacgagaccguccgcaucgagaagaucacccaguggcacaacaccagcgugguggaguacgucccguacugguccgagggcaacuacaugaacaacacggaggccaucugcgacgugaagggcuucgcccccuucagcaaggacaacgggauccggaucggcucccgcgggcacguguucgucauccgggagcccuucgugagcugcucccccaccgagugccgcaccuucuuccugacccagggcagccuccugaacgacaagcacuccaacgggacggugaaggaccggagcccguuccgcacccugauguccgucgaggugggccagagccccaacguguaccaggcgcgguucgaggccgucgccugguccgccaccgccugccacgacggcaagaaguggaugaccaucggggugacgggccccgacagcaaggcgguggccgucgugcacuacgggggcguccccaccgacguggugaacuccugggccggcgacauccuccgcacccaggagagcuccugcacgugcauccaggggaacugcuacugggucaugaccgacggcccggccaaccggcaggcgcaguaccgcaucuacaaggccaaccaggggaagaucgugggccagaccgacaucagcuucaacgggggccacaucgaggagugcagcugcuaccccaacgacggcaagguggagugcgucugccgggacaacuggaccgggaccaaccgccccgugcuggugaucucccccgaccugagcuaccgggucggcuaccucugcgccgggcugccguccgacacgccccgcggcgaggacgcccaguucaccgggagcugcaccucccccaugggcaaccagggcuacggggugaagggcuucggguuccggcagggcaccgacguguggauggggcgcacgaucagccggaccucccgcagcggcuucgagauccugcggaucaagaacggcuggacccagaccuccaaggagcagguccgcaagcaggucgugguggacaaccucaacuggagcggguacuccggcagcuucacgcugcccguggagcuguccgggaaggacugccucgugccgugcuucugggucgagaugauccgcggcaagcccgaggagaagaccaucuggaccagcuccagcuccaucgugaugugcggcguggacuacgaggucgccgacuggagcuggcacgacggggcgauccugcccuucgacaucgacaagauguga

SEQ ID NO: 84691 - RNA, 1413 nt, Artificial Sequence
  derived and/or modified sequence opt1 from neuraminidase__InfluenzaA__AGQ81931
augaaccccaaccagaagaucaucaccaucggcagccugucccucgggcuggugguccugaacauccuccugcacaucaucagcaucaccaucacggugcuggugaucccgcgcaacggcaacaccggguccugcaacgagaccgucauccgggaguacaacgagaccgugcgcaucgagaagaucacgcaguggcacaacaccaacaucaucgaguacaucgagaagcccgagaacgaccucuucaugaacaacaccggcccccugugcgacgccaagggguucgcccccuucagcaaggacaacggcauccggaucggcuccaaggggcacguguucgucauccgcgagccguucgugagcugcucccccaccgagugccggacguucuuccugacccagggcagccuccugaacgacaagcacuccaacgggaccgugaaggaccgcagccccuaccggacccugauguccgucgagaucggccagagccccaacguguaccaggcgcgcuucgaggccguggccugguccgccacggccugccacgacgggaagaaguggaugaccaucggcgucaccggcccggacgcgaaggccguggccgugguccacuacgggggcauccccaccgacgugaucaacagcugggccggggacauccuccggacgcaggaguccagcugcacgugcauccagggcgagugcuacugggugaugaccgacggccccgcgaaccgccaggcccaguaccgggccuucaaggccaagcaggggaagaucaucggccagaccgagaucuccuucaacgggggccacaucgaggagugcagcugcuaccccaacgaggggaaggucgagugcgugugccgcgacaacuggaccggcaccaaccggccggugcuggucaucuccagcgaccugagcuaccgcgugggcuaccucugcgccgggcugcccuccgacacgccccggggcgaggacagccaguucaccggguccugcaccagccccaugggcaaccagggguacggcgugaagggcuucggguuccgccagggcaacgacgucuggauggggcggaccaucucccgcaccagccgguccggcuucgagauccugaagauccgcaacggguggauccagaacagcaaggagcagaucaagcgccagguggucguggacaacuccaacuggagcggcuacuccggcagcuucacccucccgguggagcugacgcggcgcaacugccugguccccugcuucuggguggagaugauccgggggaagcccgaggagaagaccaucuggaccuccagcuccagcaucgugaugugcggcgucgaccacgagaucgcgaacugguccuggcacgacggggccauccuccccuucgacaucgacaagauguga

SEQ ID NO: 84692 - RNA, 1413 nt, Artificial Sequence
  derived and/or modified sequence opt1 from neuraminidase__InfluenzaA__AGQ81932
augaaccccaaccagaagaucaucaccaucggcagcaucucccuggggcucguggucuucaacgugcugcugcacguggucagcaucaucgugaccgugcucauccugggccgcgggggcaacaacgggaucugcaacgagacggucgugcgggaguacaacgagaccgugcgcaucgagaagaucacccaguggcacaacaccuccgucguggaguacgugccguacuggaacgagggcacguacaugaacaacaccgaggccaucugcgacgucaagggcuucgcccccuucagcaaggacaacgggauccggaucggcucccgcgggcacguguucgugauccgggagcccuucgucagcugcucccccaccgagugccgcaccuucuuccugacgcagggcagccuccugaacgacaagcacuccaacgggaccgugaaggaccggagcccguuccgcacccugauguccguggaggucggccagagccccaacguguaccaggcgcgguucgaggccguggccugguccgccaccgccugccacgacggcaagaaguggaugacgaucggggucaccggcagcgacuccaaggcgguggccgugguccacuacgggggcgugcccaccgacgucgugaacagcugggccggcgacauccuccgcacccaggaguccagcugcacgugcauccaggggaacugcuacugggugaugaccgacggccccgccaaccggcaggcgcaguaccgcaucuacaaggccaaccaggggaaggucaucggccagaccgacaucuccuucaacgggggccacaucgaggagugcagcugcuacccgaacgacggcaagguggagugcgugugccgggacaacuggaccgggacgaaccgccccguccuggugaucagccccgaccuguccuaccgggugggcuaccucugcgccgggcugcccagcgacaccccgcgcggcgaggacgcccaguucaccggguccugcaccagccccaugggcaaccagggcuacggggucaagggcuucggguuccggcagggcacggacguguggauggggcgcaccaucucccagaccagccgguccggcuucgagauccugcgcgugaagaacggcuggacccagacgagcaaggagcagguccggaagcaggucgugguggacaaccucaacugguccggguacagcggcuccuucacccugcccaucgagcugagcgggaaggacugccucgugcccugcuucuggguggagaugauccgcggcaagccggaggagaaguccaucuggaccagcuccagcuccaucgucaugugcggcguggacuacgagguggccgacuggagcuggcacgacggggcgauccugcccuucgacaucgacaagauguga

SEQ ID NO: 84693 - RNA, 1413 nt, Artificial Sequence
  derived and/or modified sequence opt1 from neuraminidase__InfluenzaA__AGQ81934
augaaccccaaccagaagauccugugcaccagcgccaccgccaucgugaucggcacgaucgcgguccucaucgggaucgccaaccugggccugaacaucgggcuccaccugaagccguccugcaacugcagccacucccagcccgagaccaccaacaccagccagacgaucaucaacaacuacuacaacgagaccaacaucacccagaucuccaacaccaacauccagauggaggagcgcgccagccgggacuucaacaaccugacgaagggccucugcaccaucaacuccuggcacaucuacgggaaggacaacgccgugcgcaucggcgagaacagcgacgugcuggucacccgggagcccuacguguccugcgaccccgacgagugccgcuucuacgcccugagccagggcaccacgauccgggggaagcacuccaacggcaccauccacgaccgcagccaguaccgggcgcucaucuccuggccgcugagcuccccgcccaccguguacaacagccgcgucgagugcaucgggugguccagcaccuccugccacgacggcaagagccggaugagcaucugcaucuccgggcccaacaacaacgccagcgccguggugugguacaaccgccggcccgucgccgagaucaacacgugggcgcgcaacauccugcggacccaggaguccgagugcgugugccacaacggcgugugccccgucguguucaccgacggcagcgccaccgggcccgccgacacgcgcaucuacuacuucaaggagggccggauccucaagugggagucccugaccgggaccgccaagcacaucgaggagugcagcugcuacggcgagcgcaccggcaucacgugcacgugccgggacaacuggcagggguccaaccgccccgugauccggaucgacccggucgccaugacccacaccagccaguacaucugcucccccgugcugaccgacaacccccgccccaacgacccgaacgugggcaagugcaacgaccccuaccccgggaacaacaacaacggcgucaagggguucagcuaccucgacggcgugaacaccuggcugggccggaccaucuccaccgcgagccgcuccggguacgagaugcugaaggugcccaacgcccucacggacgaccgcagcaagccgauccagggccagaccaucguccugaacaccgacugguccggguacagcggcuccuucauggacuacugggccgagggggacugcuaccgggccugcuucuacguggagcugauccgcggccggcccaaggaggacaaggugugguggaccagcaacuccaucgucagcaugugcagcuccacggaguuccucggccagugggacuggcccgacggggccaagaucgaguacuuccuguga

SEQ ID NO: 84694 - RNA, 1413 nt, Artificial Sequence; identical to SEQ ID NO: 84693
  derived and/or modified sequence opt1 from neuraminidase__InfluenzaA__AGQ81935

SEQ ID NO: 84695 - RNA, 1413 nt, Artificial Sequence; identical to SEQ ID NO: 84693
  derived and/or modified sequence opt1 from neuraminidase__InfluenzaA__AGQ81936

SEQ ID NO: 84696 - RNA, 1413 nt, Artificial Sequence; identical to SEQ ID NO: 84693
  derived and/or modified sequence opt1 from neuraminidase__InfluenzaA__AGQ81937

SEQ ID NO: 84697 - RNA, 1413 nt, Artificial Sequence; identical to SEQ ID NO: 84693
  derived and/or modified sequence opt1 from neuraminidase__InfluenzaA__AGQ81938

SEQ ID NO: 84698 - RNA, 1413 nt, Artificial Sequence; identical to SEQ ID NO: 84693
  derived and/or modified sequence opt1 from neuraminidase__InfluenzaA__AGQ81939

SEQ ID NO: 84699 - RNA, 1413 nt, Artificial Sequence
  derived and/or modified sequence opt1 from neuraminidase__InfluenzaA__AGQ81940
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcgccagcaagggcuucaacaaccugaccaaggggcucugcacgaucaacuccuggcacaucuacggcaaggacaacgccguccggaucggcgagagcuccgacgugcuggugacccgcgagcccuacgucagcugcgaccccgacgagugccgguucuacgcgcugucccaggggaccaccauccgcggcaagcacagcaacgggacgauccacgaccggucccaguaccgcgcccucaucagcuggccgcuguccagcccgcccaccguguacaacucccggguggagugcaucggcuggagcuccaccagcugccacgacggcaagagccgcauguccaucugcaucagcgggcccaacaacaacgccuccgccgucgugugguacaaccggcgccccguggcggagaucaacaccugggcccggaacauccugcgcacgcaggagagcgagugcgucugccacaacggcgugugccccguggucuucaccgacggguccgccaccggccccgccgacacccggaucuacuacuucaaggaggggaagauccucaagugggagagccuggccggcacggcgaagcacaucgaggagugcuccugcuacggcgagcgcaccgggaucacgugcacgugccgggacaacuggcagggcagcaaccgccccgugauccagaucgacccgguggccaugacccacaccucccaguacaucugcagccccguccugaccgacaacccccggcccaacgacccgaacaucgggaagugcaacgaccccuaccccggcaacaacaacaacggggugaagggcuucuccuaccucgacggcgccaacaccuggcuggggcgcaccaucagcaccgccucccggagcggcuacgagaugcugaaggugcccaacgcccucaccgacgaccgcuccaagccgauccaggggcagaccaucguccugaacacggacuggagcggcuacuccgggagcuucauggacuacugggcggagggcgacugcuaccgggccugcuucuacguggagcugauccgcggccgccccaaggaggacaaggugugguggaccuccaacagcaucgucagcaugugcuccagcaccgaguuccucgggcaguggaacuggcccgacggcgccaagaucgaguacuuccuguga

SEQ ID NO: 84700 - RNA, 1413 nt, Artificial Sequence
  derived and/or modified sequence opt1 from neuraminidase__InfluenzaA__AGQ81941
augaaccccaaccagaagauccugugcaccagcgccaccgccaucaucaucggcacgaucgcggugcucaucggggucgccaaccugggccugaacaucgggcuccaccugaagccgggcugcaacugcucccacagccagcccgaggccaccaacaccucccagaccaucaucaacaacuacuacaacgagacgaacaucacccagaucagcaacaccaacauccagauggaggagcgccccaaccggggguucaacaaccugaccaagggccucugcacgaucaacuccuggcacaucuacggcaaggacaacgccgugcgcaucggggagaacagcgacgugcuggucacccgggagcccuacguguccugcgacccggacgagugccgcuucuacgcccugagccagggcaccaccauccgggggaagcacuccaacggcacgauccacgaccgcagccaguaccgggcgcucaucuccuggccccugagcuccccgcccaccguguacaacagccgcgucgagugcaucgggugguccagcaccuccugccacgacggcaagagccggauguccaucugcaucagcggccccaacaacaacgccagcgccguggugugguacaaccgccggcccgucgccgagaucaacaccugggcgcgcaacauccugcggacgcaggaguccgagugcgugugccacaacggggugugccccgucguguucaccgacggcagcgccaccgggcccgccgacacccgcguguacuacuuccgggagggcaagauccucaagugggagucccugacgggcaccgcccgccacaucgaggagugcagcugcuacggggagcggaccggcaucacgugcacgugccgcgacaacuggcagggguccaaccggccggucauccagaucgaccccguggccaugacccacaccagccaguacaucugcucccccgugcugaccgacaacccccgcccgaacgaccccaacgucggcaagugcaacgaccccuaccccgggaacaacaacaacggcgugaagggcuucagcuaccucgacggggugaacaccuggcugggccggaccaucuccaccgcgagccgcuccggguacgagaugcugaaggucccgaacgcccucaccgacgaccgcagcaagcccauccagggccagacgaucgugcugaacaccgacugguccggguacagcggcuccuucauggacuacugggccgagggcgacugcuaccgggccugcuucuacguggagcugauccgcgggcggcccaaggaggacaaggucugguggaccagcaacuccaucgugagcaugugcuccagcaccgaguuccucggccagugggacuggcccgacggggccaagaucgaguacuuccuguga

SEQ ID NO: 84701 - RNA, 1413 nt, Artificial Sequence
  derived and/or modified sequence opt1 from neuraminidase__InfluenzaA__AGQ81942
augaaccccaaccagaagauccugugcaccagcgccaccgccaucaucaucggcacgaucgcggugcucaucggggucgccaaccugggccugaacaucgggcuccaccugaagccgggcugcaacugcucccacagccagcccgaggccaccaacaccucccagaccaucaucaacaacuacuacaacgagacgaacaucacccagaucagcaacaccaacauccagauggaggagcgccccucccggggguucaacaaccugaccaagggccucugcacgaucaacagcuggcacaucuacggcaaggacaacgccgugcgcaucggggagaacuccgacgugcuggucacccgggagcccuacgugagcugcgacccggacgagugccgcuucuacgcccugucccagggcaccaccauccgggggaagcacagcaacggcacgauccacgaccgcucccaguaccgggcgcucaucagcuggccccuguccagcccgcccaccguguacaacucccgcgucgagugcaucggguggagcuccaccagcugccacgacggcaagucccggaugagcaucugcaucagcggccccaacaacaacgccuccgccaucgugugguacaaccgccggcccguggccgagaucaacaccugggcgcgcaacauccugcggacgcaggagagcgagugcgucugccacaacggggugugccccguggucuucaccgacggcuccgccaccgggcccgccgacacccgcguguacuacuuccgggagggcaagauccucaagugggagagccugacgggcaccgcccgccacaucgaggagugcuccugcuacggggagcggaccggcaucacgugcacgugccgcgacaacuggcaggggagcaaccggccggugauccagaucgaccccgucgccaugacccacaccucccaguacaucugcagccccgugcugaccgacaacccccgcccgaacgaccccaacgugggcaagugcaacgaccccuaccccgggaacaacaacaacggcgucaagggcuucuccuaccucgacggggugaacaccuggcugggccggaccaucagcaccgcgucccgcagcggguacgagaugcugaaggugccgaacgcccucaccgacgaccgcuccaagcccauccagggccagacgaucauccugaacaccgacuggagcggguacuccggcagcuucauggacuacugggccgagggcgacugcuaccgggccugcuucuacgucgagcugauccgcgggcggcccaaggaggacaaggugugguggaccuccaacagcaucguguccaugugcagcagcaccgaguuccucggccagugggacuggcccgacggggccaagaucgaguacuuccuguga

SEQ ID NO: 84702 - RNA, 1413 nt, Artificial Sequence
  derived and/or modified sequence opt1 from neuraminidase__InfluenzaA__AGQ81943
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcaccagccggggcuucaacaaccugacgaaggggcucugcaccaucaacuccuggcacaucuacggcaaggacaacgccauccgcaucggcgagagcuccgacguccuggugacccgggagcccuacgugagcugcgaccccgacgagugccgcuucuacgcccugucccaggggaccacgauccggggcaagcacagcaacgggaccauccacgaccgcucccaguaccgggcgcucaucagcuggccgcuguccagcccgcccaccgucuacaacucccgcguggagugcaucggcuggagcuccaccagcugccacgacggcaagagccggauguccaucugcaucagcgggcccaacaacaacgccuccgccguggucugguacaaccgccggcccguggccgagaucaacacgugggcgcgcaacauccugcggacccaggagagcgagugcgugugccacaacggcgucugccccgugguguucaccgacggguccgccaccggccccgccgacacgcgcaucuacuacuucaaggaggggcggauccucaagugggagagccugaccggcaccgccaagcacaucgaggagugcuccugcuacggcgagcgcaccgggaucacgugcacgugccgggacaacuggcagggcagcaaccgccccgucauccagaucgacccgguggccaugacccacaccucccaguacaucugcagccccgugcugaccgacaacccccggcccaacgacccgaacaucgggaagugcaacgaccccuaccccggcaacaacaacaacggggucaagggcuucuccuaccucgacggcgcgaacaccuggcuggggcgcaccaucagcaccgccucccggagcggcuacgagaugcugaaggugcccaacgcccucacggacgaccgcuccaagccgauccaggggcagaccaucgugcugaacaccgacuggagcggcuacuccgggagcuucauggacuacugggccgagggcgacugcuaccgcgccugcuucuacgucgagcugauccggggccgccccaaggaggacaaggugugguggaccuccaacagcaucgugagcaugugcuccagcacggaguuccucgggcaguggaacuggcccgacggcgcgaagaucgaguacuuccuguga

SEQ ID NO: 84703 - RNA, 1413 nt, Artificial Sequence; identical to SEQ ID NO: 84693
  derived and/or modified sequence opt1 from neuraminidase__InfluenzaA__AGQ81944

SEQ ID NO: 84704 - RNA, 1413 nt, Artificial Sequence
  derived and/or modified sequence opt1 from neuraminidase__InfluenzaA__AGQ81947
augaaccccaaccagaagauccugugcaccagcgccaccgcccucgugaucggcacgaucgcgguccugaucgggaucgccaaccugggccucaacaucgggcugcaccugaagccguccugcaacugcagccacucccagcccgaggccaccaacaccagccagaccaucaucaacaacuacuacaacgagacgaacaucacccagaucuccaacaccaacauccagauggaggagcgcgccagccgguccuucaacaaccucaccaagggccugugcacgaucaacagcuggcacaucuacgggaaggacaacgccauccgcaucggcgagaacuccgacgugcuggugacccgggagcccuacgucagcugcgaccccgacgagugccgcuucuacgcgcucucccagggcaccaccauccgggggaagcacagcaacggcacgauccacgaccgcucccaguaccgggcccugaucagcuggccgcuguccagcccgcccaccguguacaacucccgcguggagugcaucggguggagcuccaccagcugccacgacggcaagagccggauguccaucugcaucagcgggcccaacaacaacgccuccgccgucgugugguacaaccgccggcccguggcggagaucaacaccugggcccgcaacauccuccggacgcaggagagcgagugcgucugccacaacggcgugugccccguggucuucaccgacggcuccgccaccgggcccgccgacacccgcaucuacuacuucaaggagggcaagauccugaagugggagagccugacggggaccgccaagcacaucgaggagugcuccugcuacggcgagcggaccggcaucacgugcacgugccgcgacaacuggcaggggagcaaccggcccgugauccagaucgacccgguggcgaugacccacaccucccaguacaucugcagccccguccucaccgacaacccccgccccaacgacccgaacgugggcaagugcaacgaccccuaccccgggaacaacaacaacggcgugaagggguucuccuaccuggacggcgucaacaccuggcugggccggaccaucagcaccgccucccgcagcggguacgagaugcucaaggugcccaacgcccugaccgacgaccgguccaagccgauccagggccagacgaucgugcugaacaccgacuggagcggguacuccggcagcuucauggacuacugggccgagggggacugcuaccgcgccugcuucuacgucgagcucauccgcggccggcccaaggaggacaaggugugguggaccuccaacagcaucgugagcaugugcuccagcaccgaguuccugggccaguggaacuggcccgacggggcgaagaucgaguacuuccuguga

SEQ ID NO: 84705 - RNA, 1413 nt, Artificial Sequence
  derived and/or modified sequence opt1 from neuraminidase__InfluenzaA__AGQ81948
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcaccagccggggcuucaacaaccugacgaaggggcucugcaccaucaacuccuggcacaucuacggcaaggacaacgccauccgcaucggcgagagcuccgacguccuggugacccgggagcccuacgugagcugcgaccccgacgagugccgcuucuacgcccugucccaggggaccacgauccggggcaagcacagcaacgggaccauccacgaccgcucccaguaccgggcgcucaucagcuggccgcuguccagcccgcccaccgucuacaacucccgcguggagugcaucggcuggagcuccaccagcugccacgacggcaagagccggauguccaucugcaucagcgggcccaacaacaacgccuccgccguggucugguacaaccgccggcccguggccgagaucaacacgugggcgcgcaacauccugcggacccaggagagcgagugcgugugccacaacggcgucugccccgugguguucaccgacggguccgccaccggccccgccgacacgcgcaucuacuacuucaaggaggggcggauccucaagugggagagccugaccggcaccgccaagcacaucgaggagugcuccugcuacggcgagcgcaccgggaucacgugcacgugccgggacaacuggcagggcagcaaccgccccgucauccagaucgacccgguggccaugacccacaccucccaguacaucugcagccccgugcugaccgacaacccccggcccaacgacccgaacaucgggaagugcaacgaccccuaccccggcaacaacaacaacggggucaagggcuucuccuaccucgacggcgcgaacaccuggcuggggcgcaccaucagcaccgccucccggagcggcuacgagaugcugaaggugcccaacgcccucacggacgaccgcuccaagccgauccaggggcagaccaucgugcugaacaccgacuggagcggcuacuccgggagcuucauggacuacugggccgagggcgagugcuaccgcgccugcuucuacgucgagcugauccggggccgccccaaggaggacaaggugugguggaccuccaacagcaucgugagcaugugcuccagcacggaguuccucgggcaguggaacuggcccgacggcgcgaagaucgaguacuuccuguga

SEQ ID NO: 84706 - RNA, 1413 nt, Artificial Sequence
  derived and/or modified sequence opt1 from neuraminidase__InfluenzaA__AGQ81951
augaaccccaaccagaagauccugugcaccagcgccaccgccaucgugaucggcacgaucgcgguccucaucgggguggccaaccugggccugaacaucgggcuccaccugaagccgggcugcaacugcucccagagccagcccgaggccaccaacaccucccagaccaucaucaacaacuacuacaacgagacgaacaucacccagaucagcaacaccaacauccagauggaggagcgcgccaaccggggguucaacaaccugaccaagggccucugcacgaucaacuccuggcacaucuacggcaaggacaacgccgugcgcaucggggagaacagcgacguccuggugacccgggagcccuacguguccugcgaccccgacgagugccgcuucuacgcgcugagccagggcaccaccauccgggggaagcacuccaacggcacgauccacgaccgcagccaguaccgggcccucaucuccuggccgcugagcuccccgcccaccgucuacaacagccgcguggagugcaucgggugguccagcaccuccugccacgacggcaagagccggauguccaucugcaucagcggccccaacaacaacgccagcgccguggucugguacaaccgccggcccguggcggagaucaacaccugggcccgcaacauccugcggacgcaggaguccgagugcgugugccacaacggggucugccccgugguguucaccgacggcagcgccaccgggcccgccgacacccgcgucuacuacuuccgggagggcaagauccucaagugggagucccugacgggcaccgccaagcacaucgaggagugcagcugcuacggggagcgcaccggcaucacgugcacgugccgggacaacuggcagggguccaaccgccccgugauccagaucgacccgguggcgaugacccacaccagccaguacaucugcucccccguccugaccgacaacccccggcccaacgacccgaacgugggcaagugcaacgaccccuaccccgggaacaacaacaacggcgugaagggcuucagcuaccucgacggggucaacaccuggcugggccgcaccaucuccaccgccagccgguccggguacgagaugcugaaggugcccaacgcccucaccgacgaccgcagcaagccgauccagggccagacgaucgugcugaacaccgacugguccggguacagcggcuccuucauggacuacugggccgagggcgacugcuaccgcgccugcuucuacgucgagcugauccgggggcgccccaaggaggacaaggugugguggaccagcaacuccaucgucagcaugugcuccagcaccgaguuccucggccaguggaacuggcccgacggggcgaagaucgaguacuuccuguga

SEQ ID NO: 84707 - RNA, 1413 nt, Artificial Sequence
  derived and/or modified sequence opt1 from neuraminidase__InfluenzaA__AGQ81952
augaaccccaaccagaagauccugugcaccagcgccaccgccaucgugaucggcacgaucgcgguccucaucgggguggccaaccugggccugaacaucgggcuccaccugaagccgggcugcaacugcucccacagccagcccgaggccaccaacaccucccagaccaucaucaacaacuacuacaacgagacgaacaucacccagaucagcaacaccaacauccagauggaggagcgcgccaaccggggguucaacaaccugaccaagggccucugcacgaucaacuccuggcacaucuacggcaaggacaacgccgugcgcaucggggagaacagcgacguccuggugacccgggagcccuacguguccugcgaccccgacgagugccgcuucuacgcgcugagccagggcaccaccauccgggggaagcacuccaacggcacgauccacgaccgcagccaguaccgggcccucaucuccuggccgcugagcuccccgcccaccgucuacaacagccgcguggagugcaucgggugguccagcaccuccugccacgacggcaagagccggauguccaucugcaucagcggccccaacaacaacgccagcgccguggucugguacaaccgccggcccguggcggagaucaacaccugggcccgcaacauccugcggacgcaggaguccgagugcgugugccacaacggggucugccccgugguguucaccgacggcagcgccaccgggcccgccgacacccgcgucuacuacuuccgggagggcaagauccucaagugggagucccugacgggcaccgccaagcacaucgaggagugcagcugcuacggggagcgcaccggcaucacgugcacgugccgggacaacuggcagggguccaaccgccccgugauccagaucgacccgguggcgaugacccacaccagccaguacaucugcucccccguccugaccgacaacccccggcccaacgacccgaacgugggcaagugcaacgaccccuaccccgggaacaacaacaacggcgugaagggcuucagcuaccucgacggggucaacaccuggcugggccgcaccaucuccaccgccagccgguccggguacgagaugcugaaggugcccaacgcccucaccgacgaccgcagcaagccgauccagggccagacgaucgugcugaacaccgacugguccggguacagcggcuccuucauggacuacugggccgagggcgacugcuaccgcgccugcuucuacgucgagcugauccgggggcgccccaaggaggacaaggugugguggaccagcaacuccaucgucagcaugugcuccagcaccgaguuccucggccaguggaacuggcccgacggggcgaagaucgaguacuuccuguga

SEQ ID NO: 84708 - RNA, 1413 nt, Artificial Sequence
  derived and/or modified sequence opt1 from neuraminidase__InfluenzaA__AGQ81954
augaaccccaaccagaagauccugugcaccagcgccaccgccaucgugaucggcacgaucgcgguccucaucgggguggccaaccugggccugaacaucgggcuccaccugaagccguccugcaacugcagccacucccagcccgaggccaccaacaccagccagaccaucaucaacaacuacuacaacgagacgaacaucacccagaucuccaacaccaacauccagauggaggagcgcgccagccggggcuucaacaaccugaccaaggggcucugcacgaucaacuccuggcacaucuacggcaaggacaacgccgugcgcaucggcgagaacagcgacguccuggugacccgggagcccuacguguccugcgaccccgacgagugccgcuucuacgcgcugagccaggggaccaccauccggggcaagcacuccaacgggacgauccacgaccgcagccaguaccgggcccucaucuccuggccgcugagcuccccgcccaccgucuacaacagccgcguggagugcaucggcugguccagcaccuccugccacgacggcaagagccggaugagcaucugcaucuccgggcccaacaacaacgccagcgccguggucugguacaaccgccggcccguggcggagaucaacaccugggcccgcaacauccugcggacgcaggaguccgagugcgugugccacaacggcgucugccccgugguguucaccgacgggagcgccaccggccccgccgacacccgcgucuacuacuucaaggaggggaagauccucaagugggagucccugacgggcaccgccaagcacaucgaggagugcagcugcuacggcgagcggaccgggaucacgugcacgugccgcgacaacuggcagggcuccaaccggcccgugauccagaucgacccgguggcgaugacccacaccagccaguacaucugcucccccguccugaccgacaacccccgccccaacgacccgaacguggggaagugcaacgaccccuaccccggcaacaacaacaacggggugaagggcuucagcuaccucgacggcgucaacaccuggcuggggcggaccaucuccaccgccagccgcuccggcuacgagaugcugaaggugcccaacgcccucaccgacgaccggagcaagccgauccaggggcagacgaucgugcugaacaccgacugguccggcuacagcggguccuucauggacuacugggccgagggcgacugcuaccgcgccugcuucuacgucgagcugauccgcggccggcccaaggaggacaaggugugguggaccagcaacuccaucgucagcaugugcagcuccaccgaguuccucgggcaguggaacuggcccgacggcgcgaagaucgaguacuuccuguga

SEQ ID NO: 84709 - RNA, 1413 nt, Artificial Sequence
  derived and/or modified sequence opt1 from neuraminidase__InfluenzaA__AGQ81956
augaaccccaaccagaagauccugugcaccagcgccaccgccaucgugaucggcacgaucgcgguccucaucgggguggccaaccugggccugaacaucgggcuccaccugaagccguccugcaacugcagccacucccagcccgaggccaccaacaccagccagaccaucaucaacaacuacuacaacgagacgaacaucacccagaucuccaacaccaacauccagauggaggagcgcgccagccggggcuucaacaaccugaccaaggggcucugcacgaucaacuccuggcacaucuacggcaaggacaacgccgugcgcaucggcgagaacagcgacguccuggugacccgggagcccuacguguccugcgaccccgacgagugccgcuucuacgcgcugagccaggggaccaccauccggggcaagcacuccaacgggacgauccacgaccgcagccaguaccgggcccucaucuccuggccgcugagcuccccgcccaccgucuacaacagccgcguggagugcaucggcugguccagcaccuccugccacgacggcaagagccggaugagcaucugcaucuccgggcccaacaacaacgccagcgccaucgugugguacaaccgccggcccgucgcggagaucaacaccugggcccgcaacauccugcggacgcaggaguccgagugcgugugccacaacggcgugugccccgucguguucaccgacgggagcgccaccggccccgccgacacccgcguguacuacuucaaggaggggaagauccucaagugggagucccugacgggcaccgccaagcacaucgaggagugcagcugcuacggcgagcggaccgggaucacgugcacgugccgcgacaacuggcagggcuccaaccggcccgucauccagaucgacccgguggcgaugacccacaccagccaguacaucugcucccccgugcugaccgacaacccccgccccaacgacccgaacgucgggaagugcaacgaccccuaccccggcaacaacaacaacggggugaagggcuucagcuaccucgacggcgugaacaccuggcuggggcggaccaucuccaccgccagccgcuccggcuacgagaugcugaagguccccaacgcccucaccgacgaccggagcaagccgauccaggggcagacgaucgugcugaacaccgacugguccggcuacagcggguccuucauggacuacugggccgagggcgacugcuaccgcgccugcuucuacguggagcugauccgcggccggcccaaggaggacaaggucugguggaccagcaacuccaucgugagcaugugcagcuccaccgaguuccucgggcaguggaacuggcccgacggcgcgaagaucgaguacuuccuguga

SEQ ID NO: 84710 - RNA, 1413 nt, Artificial Sequence
  derived and/or modified sequence opt1 from neuraminidase__InfluenzaA__AGQ81957
augaaccccaaccagaagauccugugcaccagcgccaccgccaucgugaucggcacgaucgcgguccucaucgggaucgccaaccugggccugaacaucgggcuccaccugaagccguccugcaacugcagccacucccagcccgaggccaccaacaccagccagaucaucaucaacaacuacuacaacgagaccaacaucacccagguguccaacaccaacauccagauggaggagcgcgccagccggggcuucaacaaccugaccaaggggcucugcaccaucaacuccuggcacaucuacggcaaggacaacgccgugcgcaucggcgagaacagcgacguccuggugacgcgggagcccuacguguccugcgaccccgacgagugccgcuucuacgcgcugagccaggggaccaccauccggggcaagcacuccaacgggaccauccacgaccgcagccaguaccgggcccucaucuccuggccgcugagcuccccgcccacggucuacaacagccgcguggagugcaucggcugguccagcaccuccugccacgacggcaagagccggaugagcaucugcaucuccgggcccaacaacaacgccagcgccguggucugguacaaccgccggcccguggcggagaucaacaccugggcccgcaacauccugcggacccaggaguccgagugcgugugccacaacggcgucugccccgugguguucacggacgggagcgccaccggccccgccgacacccgcaucuacuacuucaaggaggggaagauccucaagugggagucccugaccggcacggccaagcacaucgaggagugcagcugcuacggcgagcggaccgggaucacgugcacgugccgcgacaacuggcagggcuccaaccggcccgucauccagaucgacccgguggcgaugacccacaccagccaguacaucugcucccccgugcugaccgacaacccccgccccaacgacccgaacgucgggaagugcaacgaccccuaccccggcaacaacaacaacggggugaagggcuucagcuaccucgacggcgugaacaccuggcuggggcggacgaucuccaccgccagccgcuccggcuacgagaugcugaagguccccaacgcccucaccgacgaccggagcaagccggugcaggggcagaccaucgugcugaacacggacugguccggcuacagcggguccuucauggacuacugggccgagggcgacugcuaccgcgccugcuucuacgucgagcugauccgcggccggcccaaggaggacaaggugugguggaccagcaacuccaucgucagcaugugcagcuccaccgaguuccucgggcaguggaacuggcccgacggcgcgaagaucgaguacuuccuguga

SEQ ID NO: 84711 - RNA, 1413 nt, Artificial Sequence; identical to SEQ ID NO: 84693
  derived and/or modified sequence opt1 from neuraminidase__InfluenzaA__AGQ81958

SEQ ID NO: 84712 - RNA, 1413 nt, Artificial Sequence; identical to SEQ ID NO: 84693
  derived and/or modified sequence opt1 from neuraminidase__InfluenzaA__AGQ81959

SEQ ID NO: 84713 - RNA, 1413 nt, Artificial Sequence
  derived and/or modified sequence opt1 from neuraminidase__InfluenzaA__AGQ81960
augaaccccaaccagaagauccugugcaccagcgccaccgccaucgugaucggcacgaucgcgguccucaucgggaucgccaaccugggccugaacaucgggcuccaccugaagccgaacugcaacugcucccgcagccagcccgagaccaccaacaccucccagacgaucaucaacaacuacuacaacgagaccaacaucacccagaucagcaacaccaacauccagauggaggagcgggccucccgcgacuucaacaaccugacgaagggccucugcaccaucaacagcuggcacaucuacgggaaggacaacgccgugcggaucggcgagaacuccgacgugcuggucacccgcgagcccuacgugagcugcgaccccaacgagugccgguucuacgcccugucccagggcaccacgauccgcgggaagcacagcaacggcaccauccacgaccggucccaguaccgcgcgcucaucagcuggccgcuguccagcccgcccaccguguacaacucccgggucgagugcaucggguggagcuccaccagcugccacgacggcaagucccgcaugagcaucugcaucagcgggcccaacaacaacgccuccgccguggugugguacaaccggcgccccgucgccgagaucaacacgugggcgcggaacauccugcgcacccaggagagcgagugcgugugccacaacggcgugugccccgucguguucaccgacggcuccgccaccgggcccgccgacacgcggaucuacuacuucaaggagggcaagauccucaagugggagagccugaccgggaccgccaagcacaucgaggagugcuccugcuacggcgagcgcaccgagaucacgugcacgugccgggacaacuggcagggcagcaaccgccccgugauccagaucgacccggucgccaugacccacaccucccaguacaucugcagccccgugcugaccgacaacccccggcccaacgacccgaacguggggaagugcaacgaccccuaccccggcaacaacaacaacggggucaagggcuucuccuaccucgacggggugaacaccuggcugggccgcaccaucagcaccgcgucccggagcggcuacgagaugcugaaggugcccaacgcccucacggacgaccgcuccaagccgauccaggggcagaccaucguccugaacaccgacuggagcggcuacuccgggagcuucauggacuacugggccgagggcgacugcuaccgcgccugcuucuacguggagcugauccgggggcgccccaaggaggacaaggugugguggaccuccaacagcaucgucuccaugugcagcagcacggaguuccucggccagugggacuggcccgacggcgccaagaucgaguacuuccuguga

SEQ ID NO: 84714 - RNA, 1413 nt, Artificial Sequence; identical to SEQ ID NO: 84706
  derived and/or modified sequence opt1 from neuraminidase__InfluenzaA__AGQ81961

SEQ ID NO: 84715 - RNA, 1413 nt, Artificial Sequence; identical to SEQ ID NO: 84706
  derived and/or modified sequence opt1 from neuraminidase__InfluenzaA__AGQ81962

SEQ ID NO: 84716 - RNA, 1413 nt, Artificial Sequence
  derived and/or modified sequence opt1 from neuraminidase__InfluenzaA__AGQ81963
augaaccccaaccagaagauccugugcaccagcgccaccgccaucgugaucggcacgaucgcgguccucaucgggaucgccaaccugggccugaacaucgggcuccaccugaagccguccugcaacugcagccacucccagcccgaggagaccaacaccagccagaccaucaucaacaacuacuacaacgagacgaacaucacccagaucuccaacaccaacauccagauggaggagcgcgccagccggggcuucaacaaccugaccaaggggcucugcacgaucaacuccuggcacaucuacggcaaggacaacgccgugcgcaucggcgagaacagcgacgugcuggucacccgggagcccuacguguccugcgaccccaacgagugccgcuucuacgcccugagccaggggaccaccauccggggcaagcacuccaacgggacgauccacgaccgcagccaguaccgggcgcucaucuccuggccgcugagcuccccgcccaccguguacaacagccgcgucgagugcaucggcugguccagcaccuccugccacgacggcaagagccggaugagcgugugcaucuccgggcccaacgacaacgccagcgccguggucugguacaaccgccggcccguggccgagaucaacaccugggcgcgcaacauccugcggacgcaggaguccgagugcgugugccacaacggcgucugccccgugguguucaccgacgggagcgccaccggccccgcccacacccgcaucuacuacuucaaggaggggaagauccucaagugggagucccugacgggcaccgccaagcacaucgaggagugcagcugcuacggcgagcggaccgggaucacgugcacgugccgcgacaacuggcagggcuccaaccggcccgucauccagaucgacccgguggccaugacccacaccagccaguacaucugcucccccgugcugaccgacaacccccgccccaacgacccgaacgucgggaagugcaacgaccccuaccccggcaacaacaacaacggggugaagggcuucagcuaccucgacggcgugaacaccuggcuggggcggaccaucuccaccgcgagccgcuccggcuacgagaugcugaagguccccaacgcccucaccgacgaccggagcaagccgauccaggggcagacgaucgugcugaacaccgacugguccggcuacagcggguccuucauggacuacuggaccgagggcgacugcuaccgcgccugcuucuacguggagcugauccgcggccggcccaaggaggacaaggucugguggaccagcaacuccaucgugagcaugugcagcuccacggaguuccucgggcagugggacuggcccgacggcgccaagaucgaguacuuccuguga

SEQ ID NO: 84717 - RNA, 1413 nt, Artificial Sequence
  derived and/or modified sequence opt1 from neuraminidase__InfluenzaA__AGQ81964
augaaccccaaccagaagauccugugcaccagcgccaccgccaucgugaucggcacgaucgcgguccucaucgggaucgccaaccugggccugaacaucgggcuccaccugaagccguccugcaacugcagccacuccaagcccgaggagaccaacgccagccagaccaucaucaacaacuacuacaacgagaccaacaucacgcagaucuccaacaccaacauccagauggaggagcgcgccagccggggcuucaacaaccugaccaaggggcucugcaccaucaacuccuggcacaucuacggcaaggacaacgccgugcgcaucggcgagagcuccgacgugcuggucacgcgggagcccuacgugagcugcgaccccgacgagugccgcuucuacgcgcugucccaggggaccaccauccggggcaagcacagcaacgggaccauccacgaccgcucccaguaccgggcccucaucagcuggccgcuguccagcccgcccacgguguacaacucccgcgucgagugcaucggcuggagcuccaccagcugccacgacggcaagagccggauguccaucugcaucagcgggcccaacaacaacgccuccgccguggugugguacaaccgccggcccgucgcggagaucaacaccugggcccgcaacauccugcggacccaggagagcgagugcgugugccacaacggcgugugccccgucguguucacggacggguccgccaccggccccgccgacacccgcaucuacuacuucaaggaggggaagauccucaagugggagagccugaccggcacggccaagcacaucgaggagugcuccugcuacggcgagcggaccgggaucacgugcacgugccgcgacaacuggcagggcagcaaccggcccgugauccagaucgacccggucgcgaugacccacaccucccaguacaucugcagccccgugcugaccgacaacccccgccccaacgacccgaacguggggaagugcaacgaccccuaccccggcaacaacaacaacggggucaagggcuucuccuaccucgacggcgugaacaccuggcuggggcggaccaccagcaccaccucccgcagcggcuacgagaugcugaaggugcccaacgcccucacggacgaccgguccaagccgauccaggggcagaccaucguccugaacaccgacuggagcggcuacuccgggagcuucauggacuacugggccgagggcgacugcuaccgcgccugcuucuacguggagcugauccgcggccggcccaaggaggacaaggugugguggaccuccaacagcaucgucagcaugugcuccagcacggaguuccucgggcaguggaacuggcccgacggcgccaagaucgaguacuuccuguga

SEQ ID NO: 84718 - RNA, 1413 nt, Artificial Sequence
  derived and/or modified sequence opt1 from neuraminidase__InfluenzaA__AGQ81966
augaaccccaaccagcgcauccugugcaccagcgccaccgccaucgugaucggcacgaucgcgguccucaucgggguggccaaccugggccugaacaucgggcuccaccugaagccgggcugcaacugcucccacagccagcccgaggccaccaacaccucccagaccaucaucaacaacuacuacaacgagacgaacaucacccagaucagcaacaccaacauccagauggaggagcgggccaaccgcggguucaacaaccugaccaagggccucugcacgaucaacuccuggcacaucuacggcaaggacaacgccgugcggaucggggagaacagcgacguccuggugacccgcgagcccuacguguccugcgaccccgacgagugccgguucuacgcgcugagccagggcaccaccauccgcgggaagcacuccaacggcacgauccacgaccggagccaguaccgcgcccucaucuccuggccgcugagcuccccgcccaccgucuacaacagccggguggagugcaucgggugguccagcaccuccugccacgacggcaagagccgcauguccaucugcaucagcggccccaacaacaacgccagcgccguggucugguacaaccggcgccccguggcggagaucaacaccugggcccggaacauccugcgcacgcaggaguccgagugcgugugccacaacggggucugccccgugguguucaccgacggcagcgccaccgggcccgccgacacccgggucuacuacuuccgcgagggcaagauccucaagugggagucccugacgggcaccgccaagcacaucgaggagugcagcugcuacggggagcggaccggcaucacgugcacgugccgcgacaacuggcagggguccaaccggcccgugauccagaucgacccgguggcgaugacccacaccagccaguacaucugcucccccguccugaccgacaacccccgccccaacgacccgaacgugggcaagugcaacgaccccuaccccgggaacaacaacaacggcgugaagggcuucagcuaccucgacggggucaacaccuggcugggccggaccaucuccaccgccagccgcuccggguacgagaugcugaaggugcccaacgcccucaccgacgaccgcagcaagccgauccagggccagacgaucgugcugaacaccgacugguccggguacagcggcuccuucauggacuacugggccgagggcgacugcuaccgggccugcuucuacgucgagcugauccgcgggcggcccaaggaggacaaggugugguggaccagcaacuccaucgucagcaugugcuccagcaccgaguuccucggccaguggaacuggcccgacggggcgaagaucgaguacuuccuguga

SEQ ID NO: 84719 - RNA, 1413 nt, Artificial Sequence
  derived and/or modified sequence opt1 from neuraminidase__InfluenzaA__AGQ81967
augaaccccaaccagaagauccugugcaccagcgccaccgccaucgugaucggcaucaucgcgguccucaucgggaucgccaaccugggccugaacaucgggcuccaccugaagccguccugcaacugcagccacucccagcccgaggccacgaacgccagccagaccaucaucaacaacuacuacaacgagaccaacaucacccagaucuccaacacgaacauccagauggaggagcgcgccagccggggcuucaacaaccugaccaaggggcucugcaccaucaacuccuggcacaucuacggcaaggacaacgcggugcgcaucggcgagaacagcgacgugcuggucacccgggagcccuacguguccugcgaccccgacgagugccgcuucuacgcccugagccaggggacgaccauccggggcaagcacuccaacgggaccauccacgaccgcagccaguaccgggcccucaucuccuggccgcugagcuccccgcccaccguguacaacagccgcgucgagugcaucggcugguccagcacguccugccacgacggcaagagccggaugagcaucugcaucuccgggcccaacaacaacgccagcgcgguggugugguacaaccgccggcccgucgccgagaucaacaccugggcccgcaacauccugcggacccaggaguccgagugcgugugccacaacggcgugugccccgucguguucaccgacgggagcgccacgggccccgccgagacccgcaucuacuacuucaaggaggggaagauccucaagugggagucccugaccggcaccgcgaagcacaucgaggagugcagcugcuacggcgagcggacggggaucacgugcacgugccgcgacaacuggcagggcuccaaccggcccgugauccagaucgacccggucgccaugacccacaccagccaguacaucugcucccccgugcugaccgacaacccccgccccaacgacccgaacguggggaagugcaacgaccccuaccccggcaacaacaacaacggggucaagggcuucagcuaccucgacggcgugaacaccuggcuggggcggaccaucuccaccgccagccgcuccggcuacgagaugcugaaggugcccaacgcccucaccgacgaccggagcaagccgauccaggggcagaucaucguccugaacaccgacugguccggcuacagcggguccuucauggacuacugggccgagggcgacugcuaccgcgcgugcuucuacguggagcugauccgcggccggcccaaggaggacaaggugugguggaccagcaacuccaucgucagcaugugcagcuccacggaguuccucgggcaguggaacuggcccgacggcgccaagaucgaguacuuccuguga

SEQ ID NO: 84720 - RNA, 1413 nt, Artificial Sequence
  derived and/or modified sequence opt1 from neuraminidase__InfluenzaA__AGQ81968
augaaccccaaccagaagauccugugcaccagcgccaccgccaucgugaucggcaucaucgcgguccucaucgggaucgccaaccugggccugaacaucgggcuccaccugaagccguccugcaacugcagccacucccagcccgaggccacgaacgccagccagaccaucaucaacaacuacuacaacgagaccaacaucacccagaucuccaacacgaacauccagauggaggagcgcgccagccggggcuucaacaaccugaccaaggggcucugcaccaucaacuccuggcacaucuacggcaaggacaacgcggugcgcaucggcgagaacagcgacauccuggugacccgggagcccuacgucuccugcgaccccgacgagugccgcuucuacgcccugagccaggggacgaccauccggggcaagcacuccaacgggaccauccacgaccgcagccaguaccggucccucaucagcuggccgcuguccagcccgcccaccguguacaacucccgcguggagugcaucggcuggagcuccacgagcugccacgacggcaagagccggauguccaucugcaucagcgggcccaacaacaacgccuccgccgucgugugguacaaccgccggcccguggcggagaucaacaccugggcccgcaacauccugcggacccaggagagcgagugcgucugccacaacggcgugugccccguggucuucaccgacggguccgccacgggccccgccgagacccgcaucuacuacuucaaggaggggaagauccucaagugggagagccugaccggcaccgccaagcacaucgaggagugcuccugcuacggcgagcggacggggaucacgugcacgugccgcgacaacuggcagggcagcaaccggcccgugauccagaucgacccgguggcgaugacccacaccucccaguacaucugcagccccguccugaccgacaacccccgccccaacgacccgaacguggggaagugcaacgaccccuaccccggcaacaacaacaacggggugaagggcuucuccuaccucgacggcgucaacaccuggcuggggcggaccaucagcaccgccucccgcagcggcuacgagaugcugaaggugcccaacgcccucaccgacgaccgguccaagccgauccaggggcagaccaucgugcugaacaccgacuggagcggcuacuccgggagcuucaucgacuacugggccgagggcgacugcuaccgcgccugcuucuacgucgagcugauccgcggccggcccaaggaggacaaggugugguggacguccaacagcaucgugagcaugugcuccagcaccgaguuccucgggcaguggaacuggcccgacggcgcgaagaucgaguacuuccuguga

SEQ ID NO: 84721 - RNA, 1413 nt, Artificial Sequence
  derived and/or modified sequence opt1 from neuraminidase__InfluenzaA__AGQ81969
augaaccccaaccagaagauccugugcaccagcgccaccgccaucgugaucggcaucaucgcgguccucaucgggaucgccaaccugggccugaacaucgggcuccaccugaagccguccugcaacugcagccacucccagcccgaggagacgaacgccagccagaccaucaucaacaacuacuacaacgagaccaacaucacccagaucuccaacacgaacauccagauggaggagcgcgccagccggggcuucaacaaccugaccaaggggcucugcaccaucaacuccuggcacaucuacggcaaggacaacgccgugcgcaucggcgagaacagcgacgugcuggucacccgggagcccuacguguccugcgaccccgacgagugccgcuucuacgcgcugagccaggggacgaccauccggggcaagcacuccaacgggaccauccacgaccgcagccaguaccgggcccucaucuccuggccgcugagcuccccgcccaccguguacaacagccgcgucgagugcaucggcugguccagcacguccugccacgacggcaagagccggaugagcaucugcaucuccgggcccaacaacaacgccagcgccguggugugguacaaccgccggcccgucgcggagaucaacaccugggcccgcaacauccugcggacccaggaguccgagugcgugugccacaacggcgugugccccgucguguucaccgacgggagcgccacgggccccgccgagacccgcaucuacuacuucaaggaggggaagauccucaagugggagucccugaccggcaccgccaagcacaucgaggagugcagcugcuacggcgagcggacggggaucacgugcacgugccgcgacaacuggcagggcuccaaccggcccgugauccagaucgacccggucgcgaugacccacaccagccaguacaucugcucccccgugcugaccgacaacccccgccccaacgacccgaacguggggaagugcaacgaccccuaccccggcaacaacaacaacggggucaagggcuucagcuaccucgacggcgugaacaccuggcuggggcggaccaucuccaccgccagccgcuccggcuacgagaugcugaaggugcccaacgcccucaccgacgaccggagcaagccgauccaggggcagaucaucguccugaacaccgacugguccggcuacagcggguccuucauggacuacugggccgagggcgacugcuaccgcgccugcuucuacguggagcugauccgcggccggcccaaggaggacaaggugugguggaccagcaacuccaucgucagcaugugcagcuccacggaguuccucgggcaguggaacuggcccgacggcgcgaagaucgaguacuuccuguga

SEQ ID NO: 84722 - RNA, 1413 nt, Artificial Sequence
  derived and/or modified sequence opt1 from neuraminidase__InfluenzaA__AGQ81970
augaaccccaaccagaagauccugugcaccagcgccaccgccaucgugaucggcacgaucgcgguccucaucgggaucgccaaccugggccugaacaucgggcuccaccugaagccguccugcaacugcagccacucccagcccgaggagaccaacgccagccagaccaucaucaacaacuacuacaacgagaccaacaucacgcagaucuccaacaccaacauccagauggaggagcgcgccagccggggcuucaacaaccugaccaaggggcucugcaccaucaacuccuggcacaucuacggcaaggacaacgccgugcgcaucggcgagaacagcgacgugcuggucacgcgggagcccuacguguccugcgaccccgacgagugccgcuucuacgcgcugagccaggggaccaccauccggggcaagcacuccaacgggaccauccacgaccgcagccaguaccgggcccucaucuccuggccgcugagcuccccgcccacgguguacaacagccgcgucgagugcaucggcugguccagcaccuccugccacgacggcaagagccggaugagcaucugcaucuccgggcccaacaacaacgccagcgccguggugugguacaacaagcgccccgucgcggagaucaacaccugggcccggaacauccugcgcacccaggaguccgagugcgugugccacaacggcgugugccccgucguguucacggacgggagcgccaccggccccgccgacacccggaucuacuacuucaaggaggggaagauccucaagugggagccccugaccggcacggccaagcacaucgaggagugcuccugcuacggcgagcgcaccgggaucacgugcacgugccgggacaacuggcagggcagcaaccgcccggugauccagaucgaccccgucgcgaugacccacaccucccaguacaucugcagccccgugcugaccgacaacccccggccgaacgaccccaacguggggaagugcaacgaccccuaccccggcaacuccaacaacggggucaagggcuucagcuaccucgacggcgugaacaccuggcuggggcgcaccaucuccaccgccagccgguccggcuacgagaugcugaaggugccgaacgcccucaccgacgaccgcagcaagcccauccaggggcagaccaucguccugaacacggacugguccggcuacagcggguccuucauggacuacugggccgagggcgacugcuaccgggccugcuucuacguggagcugauccgcggccgccccaaggaggacaaggugugguggaccagcaacuccaucgucagcaugugcagcuccaccgaguuccucgggcaguggaacuggcccgacggcgcgaagaucgaguacuuccuguga

SEQ ID NO: 84723 - RNA, 1413 nt, Artificial Sequence
  derived and/or modified sequence opt1 from neuraminidase__InfluenzaA__AGQ81971
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcaccagccggggcuucaacaaccugacgaaggggcucugcaccaucaacuccuggcacaucuacggcaaggacaacgccguccgcaucggcgagagcuccgacgugcuggugacccgggagcccuacgucagcugcgaccccgacgagugccgcuucuacgcccugucccaggggaccacgauccggggcaagcacagcaacgggaccauccacgaccgcucccaguaccgggcgcucaucagcuggccgcuguccagcccgcccaccguguacuccagccgcguggagugcaucggcugguccagcaccagcugccacgacgggaagucccggaugagcaucugcaucuccggccccaacaacaacgccagcgccgucgugugguacaaccgccggcccguggccgagaucaacacgugggcgcgcaacauccugcggacccaggaguccgagugcgucugccacaacggcgugugccccguggucuucaccgacgggagcgccaccggccccgccgacacgcgcaucuacuacuucaaggaggggaagauccucaagugggagucccugaccggcaccgccaagcacaucgaggagugcagcugcuacggcgagcggaccgggaucacgugcacgugccgcgacaacuggcagggcuccaaccggcccgugauccagaucgacccgguggccaugacccacaccagccaguacaucugcucccccguccugaccgacaacccccgccccaacgacccgaacaucgggaagugcaacgaccccuaccccggcaacaacaacaacggggugaagggcuucagcuaccucgacggcgcgaacaccuggcuggggcggaccaucuccaccgccagccgcuccggcuacgagaugcugaaggugcccaacgcccucacggacgaccggagcaagccgauccaggggcagaccaucguccugaacaccgacugguccggcuacagcggguccuucauggacuacugggccgagggcgacugcuaccgcgccugcuucuacguggagcugauccgcggccggcccaaggaggacaaggugugguggaccagcaacagcaucgucuccaugugcagcuccacggaguuccucgggcaguggaacuggcccgacggcgcgaagaucgaguacuuccuguga

SEQ ID NO: 84724 - RNA, 1413 nt, Artificial Sequence
  derived and/or modified sequence opt1 from neuraminidase__InfluenzaA__AGQ81972
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcgccagccggggcuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcgcugucccaggggaccaccauccggggcaagcacagcaacgggacgauccacgaccgcucccaguaccgggcccucaucagcuggccgcuguccagcccgcccaccguguacaacucccgcguggagugcaucggcuggagcuccaccagcugccacgacggcaagagccggauguccaucugcaucagcgggcccaacaacaacgccuccgccgucgugugguacaaccgccggcccguggcggagaucaacaccugggcccgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggcgaugacccacaccucccaguacaucugcagccccguccugaccgacaacccccgccccaacgacccgaacaucgggaagugcaacgaccccuaccccggcaacaacaacaacggggugaagggcuucuccuaccucgacggcgccaacaccuggcuggggcggaccaucagcaccgccucccgcagcggcuacgagaugcugaaggugcccaacgcccucaccgacgaccgguccaagccgauccaggggcagacgaucguccugaacaccgacuggagcggcuacuccgggagcuucauggacuacugggccgagggcgacugcuaccgcgcgugcuucuacguggagcugauccgcggccggcccaaggaggacaaggugugguggaccuccaacagcaucgucagcaugugcuccagcaccgaguuccucgggcaguggaacuggcccgacggcgccaagaucgaguacuuccuguga

SEQ ID NO: 84725 - RNA, 1413 nt, Artificial Sequence
  derived and/or modified sequence opt1 from neuraminidase__InfluenzaA__AGQ81973
augaaccccaaccagaagauccugugcaccagcgccaccgccaucaucaucggcgcgaucgccgugcucaucgggaucgccaaccugggccugaacaucgggcuccaccugaagccguccugcaacugcagccacucccagcccgagacgaccaacaccagccagaccaucaucaacaacuacuacaacgagacgaacaucacccagaucuccaacaccaacauccagauggaggagcgcaccagccggggcuucaacaaccugacgaaggggcucugcaccaucaacuccuggcacaucuacggcaaggacaacgccguccgcaucggcgagagcuccgacgugcuggugacccgggagcccuacgucagcugcgaccccgacgagugccgcuucuacgcccugucccaggggaccacgauccggggcaagcacagcaacgggaccauccacgaccgcucccaguaccgggcgcucaucagcuggccgcuguccagcccgcccaccguguacaacucccgcguggagugcaucggcuggagcuccaccagcugccacgacggcaagagccggauguccaucugcaucagcgggcccaacaacaacgccuccgccgucgugugguacaaccgccggcccguggccgagaucaacacgugggcgcgcaacauccugcggacccaggagagcgagugcgucugccacaacggcgugugccccguggucuucaccgacggguccgccaccggccccgccgacacgcgcaucuacuacuucaaggaggggaagauccucaagugggagagccugaccggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucacggacgaccgguccaagccgauccaggggcagaccaucguccugaacaccgacuggagcggcuacuccgggagcuucauggacuacugggccgagggcgacugcuaccgcgccugcuucuacguggagcugauccgcggccggcccaaggaggacaaggugugguggaccuccaacagcaucgucagcaugugcuccagcacggaguuccucgggcaguggaacuggcccgacggcgcgaagaucgaguacuuccuguga

SEQ ID NO: 84726 - RNA, 1413 nt, Artificial Sequence; identical to SEQ ID NO: 84706
  derived and/or modified sequence opt1 from neuraminidase__InfluenzaA__AGQ81974

SEQ ID NO: 84727 - RNA, 1398 nt, Artificial Sequence
  derived and/or modified sequence opt1 from neuraminidase__InfluenzaA__AGQ81975
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaguggcucugcacgaucaacuccuggcacaucuacgggaaggacaacgccguccgcaucggcgagaacagcgacgugcuggugacccgggagcccuacgucuccugcgaccccgacgagugccgcuucuacgcccugagccagggcaccaccauccgggggaagcacuccaacggcacgauccacgaccgcagccaguaccgggcgcucaucuccuggccgcugagcuccccgcccaccguguacaacagccgcguggagugcaucgggugguccagcaccuccugccacgacggcaagagccggauguccaucugcaucagcgggcccaacaacaacgccagcgccgucgugugguacaaccgccggcccguggccgagaucaacaccugggcgcgcaacauccugcggacgcaggaguccgagugcgucugccacaacggcgugugccccguggucuucaccgacggcagcgccaccgggcccgccgacacccgcaucuacuacuucaaggagggcaagauccucaagugggagucccugacggggaccgccaagcacaucgaggagugcagcugcuacggcgagcggaccggcaucacgugcacgugccgcgacaacuggcagggguccaaccggcccgugauccagaucgacccgguggccaugacccacaccagccaguacaucugcucccccguccugaccgacaacccccgccccgacgacccgaacaucggcaagugcaacgaccccuaccccgggaacaacaacaacggcgugaagggguucagcuaccucgacggcgcgaacaccuggcugggccggaccaucuccaccgccagccgcuccggguacgagaugcugaaggugcccaacgcccucaccgacgaccggagcaagccgauccagggccagacgaucguccugaacgccgacugguccggguacagcggcuccuucauggacuacugggccgacggggacugcuaccgcgcgugcuucuacguggagcugauccgcggccggcccaaggaggacaaggugugguggaccagcaacuccaucgucagcaugugcuccagcaccgaguuccucggccaguggaacuggcccgacggggccaagaucgaguacuuccuguga

SEQ ID NO: 84728 - RNA, 1398 nt, Artificial Sequence
  derived and/or modified sequence opt1 from neuraminidase__InfluenzaA__AGQ81977
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccguggucuucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgugauccagaucgacccgguggccaugacccacaccucccaguacaucugcagccccguccugaccgacaacccccgccccgacgacccgaacaucgggaagugcaacgaccccuaccccggcaacaacaacaacggggugaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagacgaucguccugaacgccgacuggagcggcuacuccgggagcuucauggacuacugggccgacggcgacugcuaccgcgcgugcuucuacguggagcugauccgcggccggcccaaggaggacaaggugugguggaccuccaacagcaucgucuccaugugcagcagcaccgaguuccucgggcaguggaacuggcccgacggcgccaagaucgaguacuuccuguga

SEQ ID NO: 84729 - RNA, 1398 nt, Artificial Sequence
  derived and/or modified sequence opt1 from neuraminidase__InfluenzaA__AGQ81979
augaaccccaaccagaagauccugugcaccagcgccaccgccaucaucaucggcgcgaucgccgcccucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccgugcgcaucggcgagagcuccgacguccuggugacccgggagcccuacgugagcugcgaccccgacgagugccgcuucuacgcgcugucccaggggaccaccauccggggcaagcacagcaacgggacgauccacgaccgcucccaguaccgggcccucaucagcuggccgcuguccagcccgcccaccgucuacaacucccgcguggagugcaucggcuggagcuccaccagcugccacgacgggaagucccggaugagcaucugcaucagcggccccaacaacaacgccuccgccguggucugguacaaccgccggcccguggcggagaucaacaccugggcccgcaacauccugcggacgcaggagagcgagugcgugugccacaacggcgucugccccgugguguucaccgacggguccgccaccggccccgccgacacccgcaucuacuacuucaaggaggggaagauccucaagugggagagccugacgggcaccgccaagcacaucgaggagugcuccugcuacggcgagcggaccgggaucacgugcacgugccgcgacaacuggcagggcagcaaccggcccgucauccagaucgacccgguggcgaugacccacaccucccaguacaucugcagccccgugcugaccgacaacccccgccccgacgacccgaacaucgggaagugcaacgaccccuaccccggcaacaacaacaacggggucaagggcuucuccuaccucgacggcgccaacaccuggcuggggcggaccaucagcaccgccucccgcagcggcuacgagaugcugaaggugcccaacgcccucaccgacgaccgguccaagccgauccaggggcagacgaucgugcugaacgccgacuggagcggcuacuccgggagcuucauggacuacugggcggacggcgacugcuaccgcgccugcuucuacgucgagcugauccgcggccggcccaaggaggacaaggugugguggaccuccaacagcaucguguccaugugcagcagcaccgaguuccucgggcaguggaacuggcccgacggcgccaagaucgaguacuuccuguga

SEQ ID NO: 84730 - RNA, 1398 nt, Artificial Sequence; identical to SEQ ID NO: 84728
  derived and/or modified sequence opt1 from neuraminidase__InfluenzaA__AGQ81980

SEQ ID NO: 84731 - RNA, 1350 nt, Artificial Sequence
  derived and/or modified sequence opt1 from neuraminidase__InfluenzaA__AGQ88501
augaaccccaaccagaagaucgugaccaucggcagcaucugcauggucaucgggaucgugucccugaugcuccagaucggcaacaugaucagcaucugggugucccacagcauccagaccgggaaccagcaccagacggagccgauccgcaacaccaacuuccugaccgagaacgccgucgccuccguggcgcugagcggcaacuccagccucugccccauccgggggugggccgugcacuccaaggacaacagcauccgcaucggcuccaagggcgacgucuucgugauccgggagcccuucaucagcugcuccaaccuggagugccgcaccuucuuccugacgcagggggcccuccugaacgacaagcacagcaacggcaccgugaaggaccggagcccccaccgcacccugauguccugcccgaucggggaggcccccucccccuacaacagccgguucgaguccgucgccuggagcgcgagcgccugccacgacggcaucuccuggcucaccaucgggaucagcggccccgacaacggcgccguggccgugcugaaguacaacgggaucaucacggacaccaucaaguccuggcgcaacaacauccugcggacccaggagagcgagugcacgugcgucaacggcuccugcuucaccgugaugaccgacgggccgagcaacggccaggcguccuacaagaucuucaagaucgagaagggcaagguggucaagagcguggagcucaacgcccccaacuaccacuacgaggagugcuccugcuaccccgacgccggggagaucaucugcgugugccgcgacaacuggcacggcagcaaccggcccugggucuccuucaaccagaaccuggaguaccagaucggguacaucugcagcggcguguucggggacaacccgcgccccaacgacggcgagggcuccugcgggcccgugagccccaacggcgccuacggggucaagggcuucuccuucaaguacgggaacggcguguggaucggccggaccaagagcacccacucccgcagcggguucgagaugaucugggacccgaacggcuggacggggaccgacuccgaguucagcaugaagcaggacaucguggccaucaccgacuggagcggcuacuccgggagcuucguccagcaccccgagcugaccggccucgacugcauccggcccugcuucuggguggagcugauccgcggccggcccaaggaguccacgaucuggaccagcggguccagcaucuccuucugcggcgucaacagcgacaccguguccuggagcuggccggacggggcggagcugcccuucaccaucgacaaguga

SEQ ID NO: 84732 - RNA, 1401 nt, Artificial Sequence; identical to SEQ ID NO: 84610
  derived and/or modified sequence opt1 from neuraminidase__InfluenzaA__AGR33906

SEQ ID NO: 84733 - RNA, 1401 nt, Artificial Sequence
  derived and/or modified sequence opt1 from neuraminidase__InfluenzaA__AGR33908
augaaccccaaccagaagaucaccgccaucggcagcgugucccugaucaucgccaucaucugccuccugaugcagaucgcgauccugaccacgaccaugacccuccacuuccgccagaacgagugcagcaacccguccaacaaccaggucaugcccugcgagcccaucaucaucgagcggaacaccgugcaccugaacagcacgaccaucgagcgcgagaucugccccaagguggccgaguacaagaacugguccaagccgcagugccagaucaccggguucgcccccuucagcaaggacaacuccauccggcugagcgccggcggggacaucugggucacccgcgagcccuacguguccugcagccccgacaagugcuaccaguucgcccucggccaggggacgacccugaagaacaagcacuccaacggcaccacccacgaccggacgccgcaccgcacccugcucaugaacgagcugggcgugcccuuccaccuggggaccaagcaggucugcaucgcguggagcuccagcuccugcuacgacggcaaggccuggcuccacaucugcgugaccggggacgacaagaacgccacggccagcaucaucuacgacggcaugcugguggacuccaucgggagcugguccaagaacauccugcggacccaggagagcgagugcgucugcaucaacgggaccugcgcgguggugaugaccgacggcagcgccuccggcgaggccgacacgcgcauccucuucauccgggagggcaagaucaucaacaucagcccccuguccgggagcgcccagcacgucgaggagugcuccugcuacccccgcuacccggaggugcggugcgugugccgcgacaacuggaagggcagcaaccggcccaucaucuacaucaacauggucgacuacuccaucgagagccgcuacgugugcuccggccuggugggggacacgccccggaacgacgacagcaccuccagcuccaacugccgcgaccccaacaacgagcggggcgccccgggggucaagggcugggcguucgacgacgggaacgacguguggaugggccgcaccaucaagaacggcagccgguccggguacgagaccuuccgcgugaucaacggcuggaccauggccaacagcaagucccagaucaaccggcaggucaucguggacagcgacaacugguccggguacagcggcaucuucagcguggaggggaagaagugcaucaaccgcugcuucuacgucgagcucauccgcggccggccccaggagccccgcgugugguggaccuccaacagcaucaucgucuucugcggcaccuccgggacguacggcaccgggagcuggcccgacggcgccgacaucaacuucaugccgaucuga

SEQ ID NO: 84734 - RNA, 1401 nt, Artificial Sequence
  derived and/or modified sequence opt1 from neuraminidase__InfluenzaA__AGR33910
augaaccccaaccagaagaucaucgccaucggcagcgugucccugaccaucgccaucaucugcuuccucaugcagaucgcgauccugaccacgaccaugacccugcacuucaagcagaacgagugcagcaagccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagcuucggcaagugcuaccaguucgcccucgggcagggcacgacccugaagaacaagcacuccaacggcaccacccacgaccggacgccccaccgcacccugcucaugaacgagcugggggugccguuccaccugggcaccaagcaggucugcaucgcguggagcuccagcuccugcuacgacgggaaggccuggcuccacaucugcgugaccggcgacgacaagaacgccacggccagcaucaucuacgacgggaugcugguggacuccaucggcagcugguccaagaacauccugcggacccaggagagcgagugcgugugcaucaacgggaccugcgcggucgugaugaccgacgggagcgccuccggcaaggccgacacgcgcauccucuucauccgggaggggaagaucaucaacauccgcccccugagcggcuccgcccagcacguggaggagugcagcugcuacccccgguaccccgagguccgcugcgugugccgggacaacuggaagggcuccaaccgcccggugcuguacaucaacauggccgacuacagcgucgaguccagcuacgugugcuccgggcucgugggcgacacgccccggaacgacgacagcuccagcuccagcaacugccgcgaccccaacaacgagcggggcgcgcccggcgucaaggggugggccuucgacgacggcaacgacguguggaugggccgcaccauccggaacgacucccgcagcggguacgagaccuuccggguggucaacggcuggaccaccgccaacuccaagagccagaucaaccgccaggugaucgucgacuccgagaacuggagcggguacagcggcaucuucuccguggaggggaagaacugcaucaaccggugcuucuacguggagcugauccgcggccgcccgcaggagccccgggucugguggaccagcaacuccaucaucguguucugcggcaccagcgggacguacggcaccggguccuggcccgacggcgccaacaucaacuucaugcccaucuga

SEQ ID NO: 84735 - RNA, 1401 nt, Artificial Sequence
  derived and/or modified sequence opt1 from neuraminidase__InfluenzaA__AGR33911
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccauccucaucgagcgcaacaccgugcaccugaacagcacgaccaucgagaaggaggucugccccaagguggccgaguacaagaacugguccaagccgcagugccagaucaccggguucgcccccuucagcaaggacaacuccauccggcugagcgccggcggggacaucugggugacccgcgagcccuacgucuccugcagccucggcaagugcuaccaguucgcccuggggcagggcacgacccugaagaacaaccacuccaacggcaccacccacgaccggacgccccaccgcacccuccugaugaacgagcugggggugccguuccaccucggcaccaagcaggucugcaucgcguggagcuccagcuccugcuacgacgggaaggccuggcugcacaucugcgugaccggcgacgacaagaacgccacggccagcaucaucuacgacgggaugcugguggacuccaucggcagcugguccaagaacauccuccggacccaggagagcgagugcgugugcaucaacgggaccugcgcggucgugaugaccgacggcagcgccuccggcaaggccgacacgcgcauccuguucauccgggaggggaagaucaucaacaucagcccccuguccggcagcgcccagcacguggaggagugcuccugcuacccccgcuaccccgagguccggugcgugugccgcgacaacuggaagggcagcaaccggccggugcucuacaucaacauggccgacuacuccaucgagagcuccuacgucugcagcgggcuggugggcgacacgccccgcaacgacgacuccagcuccagcuccaacugccgggaccccaacaacgagcgcggggcgcccggcgugaaggggugggccuucgacgacggcaacgacgucuggaugggccggaccauccgcaacaacagccgguccggguacgagaccuuccgcguggugaacggcuggaccaccgccaacagcaagucccagaucaaccggcaggucaucguggacagcgagaacuggagcggguacuccggcaucuucagcgucgaggggaagaacugcaucaaccgcugcuucuacguggagcugauccggggccgcccgcaggagccccgcgugugguggaccuccaacagcaucaucgucuucugcggcaccuccgggacguacggcaccgggagcuggcccgacggcgccaacaucaacuucaugcccaucuga

SEQ ID NO: 84736 - RNA, 1356 nt, Artificial Sequence; identical to SEQ ID NO: 84651
  derived and/or modified sequence opt1 from neuraminidase__InfluenzaA__AGR33912

SEQ ID NO: 84737 - RNA, 1356 nt, Artificial Sequence; identical to SEQ ID NO: 84681
  derived and/or modified sequence opt1 from neuraminidase__InfluenzaA__AGR33913

SEQ ID NO: 84738 - RNA, 1356 nt, Artificial Sequence; identical to SEQ ID NO: 84651
  derived and/or modified sequence opt1 from neuraminidase__InfluenzaA__AGR33915

SEQ ID NO: 84739 - RNA, 1356 nt, Artificial Sequence
  derived and/or modified sequence opt1 from neuraminidase__InfluenzaA__AGR33916
augaaccccaaccagaagcuguucgccagcuccggcguggccaucgcgcucagcguccugaaccugcucaucgggcuguccaacgugggccugaacgugagccuccaccugaaggagaccgggccgaagcaggaggagaaccugaccugcaugacgaccaaggagaccgagcucggcacccccuccuaccugcugcucaacaagagccugugcaacgucgagggguggguggugaucgccaaggacaacgccguccgcuucggcgaguccgagcagaucaucaucacgcgggagcccuacgugagcugcgaccccaacggcugcaagauguacgcccugcaccaggggaccaccauccgcaacaagcacuccaacggcaccauccacgaccggacggccuuccgcgggcucaucagcaccccgcugggcaccccgcccaccguguccaacagcgacuucaucugcgucgggugguccagcacgaccugccacgacggcaucggccggaugaccaucugcauccaggggaacaacgacaacgcgaccgccacgguguacuacaaccgccggcugaccaccaccaucaagacgugggcccgcaacauccuccggacccaggaguccgagugcgugugccacaacgggaccugcgccgucgugaugaccgacggcagcgcguccagccaggcccacacgaaggugauguacuuccacaagggccuggucgugaaggaggaggcccugaagggcuccgccaagcacaucgaggagugcagcugcuacgggcacaaccagaaggugaccugcgucugccgcgacaacuggcagggcgccaaccggcccaucaucgagaucgacaugaacacccucgagcacaccagccgcuacgugugcacggggauccugaccgacaccucccggcccggcgacaagcccaccggggacugcagcaaccccaucacgggcucccccggcgcgccgggggugaagggcuucggguuccugaacggcgacaacaccuggcucgggcgcaccaucagcccccggucccgcagcggcuucgagaugcugaagauccccaacgccggcaucgaccccaacucccggaucgccgagcgccaggagaucgucgacaacagcaacugguccggguacagcggcuccuucaucgacuacuggaacgacaacagcgagugcuacaacccgugcuucuacguggagcugauccgggggcgccccgaggaggccaaguacgugugguggaccuccaacagccucaucgcccugugcggcucccccuuccccgucgggagcggcuccuucccggacggcgcgcagauccaguacuucagcuga

SEQ ID NO: 84740 - RNA, 1356 nt, Artificial Sequence; identical to SEQ ID NO: 84681
  derived and/or modified sequence opt1 from neuraminidase__InfluenzaA__AGR33917

SEQ ID NO: 84741 - RNA, 1356 nt, Artificial Sequence; identical to SEQ ID NO: 84651
  derived and/or modified sequence opt1 from neuraminidase__InfluenzaA__AGR33918

SEQ ID NO: 84742 - RNA, 1398 nt, Artificial Sequence; identical to SEQ ID NO: 84728
  derived and/or modified sequence opt1 from neuraminidase__InfluenzaA__AGR33919

SEQ ID NO: 84743 - RNA, 1413 nt, Artificial Sequence
  derived and/or modified sequence opt1 from neuraminidase__InfluenzaA__AGR45094
augaaccccaaccagaagaucaucaccaucggcagcaucuccauggccaucgggaucaucagccugauccuccagaucggcaacaucaucuccaucugggccagccacuccauccagaccgggagccagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccagccugugcccgauccggggcugggccaucuacaccaaggacaacuccauccgcaucgggagcaagggcgacguguucgugauccgggagcccuucaucuccugcagccaccucgagugccgcacguucuuccugacccagggggcccugcucaacgacaagcacuccaacggcaccgucaaggaccggagccccuaccgcgcccugauguccugcccccugggggaggcgccgagccccuacaacucccgguucgagagcguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcccggccuccuaccgcaucuucaagaucgagaaggggaagaucaccaagagcaucgagcucgacgcccccaacuaccacuacgaggagugcuccugcuaccccgacaccggcaccgucaugugcgugugccgggacaacuggcacgggagcaaccgccccuggguguccuucaaccagaaccuggacuaccagaucggcuacaucugcagcggcgucuucggggacaacccgcggcccaaggacggcgagggguccugcaaccccgugacgguggacggcgccgacggggucaagggcuucagcuaccgcuacggcaacgggguguggaucggccggaccaaguccaacagcucccgcaagggguucgagaugaucugggaccccaacggcuggaccgacaccgacagcgacuucuccgugaagcaggacgucgugccgaugacggacuggagcggguacagcggcuccuucgugcagcaccccgagcugaccggccucgacugcaugcggcccugcuucugggucgagcugauccgcgggcggccccgcgagaacaccaccaucuggacgagcggcuccagcaucuccuucugcggggugaacagcgacaccgcgaacugguccuggccggacgacgccgagcugccccucaccaucgacaaguga

SEQ ID NO: 84744 - RNA, 1413 nt, Artificial Sequence; identical to SEQ ID NO: 79938
  derived and/or modified sequence opt1 from neuraminidase__InfluenzaA__AGR49780

SEQ ID NO: 84745 - RNA, 1410 nt, Artificial Sequence
  derived and/or modified sequence opt1 from neuraminidase__InfluenzaA__AGR49804
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugaccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgccagcgcgugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgccugcgugaacgggagcugcuucaccgucaugaccgacggcccguccaacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 84746 - RNA, 1413 nt, Artificial Sequence; identical to SEQ ID NO: 79938
  derived and/or modified sequence opt1 from neuraminidase__InfluenzaA__AGR49820

SEQ ID NO: 84747 - RNA, 1410 nt, Artificial Sequence; identical to SEQ ID NO: 77098
  derived and/or modified sequence opt1 from neuraminidase__InfluenzaA__AGR49832

SEQ ID NO: 84748 - RNA, 1413 nt, Artificial Sequence; identical to SEQ ID NO: 79938
  derived and/or modified sequence opt1 from neuraminidase__InfluenzaA__AGR49844

SEQ ID NO: 84749 - RNA, 1413 nt, Artificial Sequence; identical to SEQ ID NO: 79938
  derived and/or modified sequence opt1 from neuraminidase__InfluenzaA__AGR49856

SEQ ID NO: 84750 - RNA, 1413 nt, Artificial Sequence; identical to SEQ ID NO: 79938
  derived and/or modified sequence opt1 from neuraminidase__InfluenzaA__AGR49868

SEQ ID NO: 84751 - RNA, 1410 nt, Artificial Sequence; identical to SEQ ID NO: 77736
  derived and/or modified sequence opt1 from neuraminidase__InfluenzaA__AGR49880

SEQ ID NO: 84752 - RNA, 1410 nt, Artificial Sequence; identical to SEQ ID NO: 79492
  derived and/or modified sequence opt1 from neuraminidase__InfluenzaA__AGR49891

SEQ ID NO: 84753 - RNA, 1410 nt, Artificial Sequence
  derived and/or modified sequence opt1 from neuraminidase__InfluenzaA__AGR49903
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcgggcacugccucgaccccaacaacgaggagggcgggcacggcgugaaggggugggccuucgacgacggcaacgacgucuggaugggccggaccaucuccgagaagucccgccugggguacgagaccuucaaggugaucgagggcuggagcaaccccaagagcaagcugcagaucaaccggcaggucaucguggaccgcgggaaccgguccggcuacagcgggaucuucuccguggagggcaagagcugcaucaaccgcugcuucuacgucgagcucauccggggccgcaaggaggagaccgaggugcuguggaccagcaacuccaucguggucuucugcgggaccagcggcacguacgggaccggcuccuggccggacggggccgacaucaaccugaugcccaucuga

SEQ ID NO: 84754 - RNA, 1410 nt, Artificial Sequence; identical to SEQ ID NO: 77098
  derived and/or modified sequence opt1 from neuraminidase__InfluenzaA__AGR49915

SEQ ID NO: 84755 - RNA, 1410 nt, Artificial Sequence; identical to SEQ ID NO: 77098
  derived and/or modified sequence opt1 from neuraminidase__InfluenzaA__AGR49927

SEQ ID NO: 84756 - RNA, 1410 nt, Artificial Sequence
  derived and/or modified sequence opt1 from neuraminidase__InfluenzaA__AGR49939
augaaccccaacaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgacaucaaccugaugcccaucuga

SEQ ID NO: 84757 - RNA, 1410 nt, Artificial Sequence; identical to SEQ ID NO: 77693
  derived and/or modified sequence opt1 from neuraminidase__InfluenzaA__AGR49951

SEQ ID NO: 84758 - RNA, 1410 nt, Artificial Sequence
  derived and/or modified sequence opt1 from neuraminidase__InfluenzaA__AGR49963
augaaccccaacaagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcgggcacugccucgaccccaacaacgaggagggcgggcacggcgugaaggggugggccuucgacgacggcaacgacgucuggaugggccgcaccaucuccaagaagucccggcugggguacgagaccuucaaggugaucgagggcuggagcaaccccaagagcaagcugcagaucaaccgccaggucaucguggaccgggggaaccgcuccggcuacagcgggaucuucuccguggagggcaagagcugcaucaaccggugcuucuacgucgagcucauccgcggccggaaggaggagaccgaggugcuguggaccagcaacuccaucguggucuucugcgggaccagcggcacguacgggaccggcuccuggccggacggggccgacaucaaccugaugcccaucuga

SEQ ID NO: 84759 - RNA, 1410 nt, Artificial Sequence; identical to SEQ ID NO: 77736
  derived and/or modified sequence opt1 from neuraminidase__InfluenzaA__AGR49975

SEQ ID NO: 84760 - RNA, 1413 nt, Artificial Sequence; identical to SEQ ID NO: 79938
  derived and/or modified sequence opt1 from neuraminidase__InfluenzaA__AGR49986

SEQ ID NO: 84761 - RNA, 1413 nt, Artificial Sequence; identical to SEQ ID NO: 79938
  derived and/or modified sequence opt1 from neuraminidase__InfluenzaA__AGR49998

SEQ ID NO: 84762 - RNA, 1410 nt, Artificial Sequence; identical to SEQ ID NO: 77736
  derived and/or modified sequence opt1 from neuraminidase__InfluenzaA__AGR50010

SEQ ID NO: 84763 - RNA, 1410 nt, Artificial Sequence; identical to SEQ ID NO: 77736
  derived and/or modified sequence opt1 from neuraminidase__InfluenzaA__AGR50021

SEQ ID NO: 84764 - RNA, 1410 nt, Artificial Sequence; identical to SEQ ID NO: 77746
  derived and/or modified sequence opt1 from neuraminidase__InfluenzaA__AGR50032

SEQ ID NO: 84765 - RNA, 1410 nt, Artificial Sequence
  derived and/or modified sequence opt1 from neuraminidase__InfluenzaA__AGR50043
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggacauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgaccugaaccucaugcccaucuga

SEQ ID NO: 84766 - RNA, 1410 nt, Artificial Sequence; identical to SEQ ID NO: 77736
  derived and/or modified sequence opt1 from neuraminidase__InfluenzaA__AGR50055

SEQ ID NO: 84767 - RNA, 1410 nt, Artificial Sequence
  derived and/or modified sequence opt1 from neuraminidase__InfluenzaA__AGR50066
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuucaagaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugagcuucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 84768 - RNA, 1410 nt, Artificial Sequence; identical to SEQ ID NO: 77736
  derived and/or modified sequence opt1 from neuraminidase__InfluenzaA__AGR50077

SEQ ID NO: 84769 - RNA, 1410 nt, Artificial Sequence; identical to SEQ ID NO: 77736
  derived and/or modified sequence opt1 from neuraminidase__InfluenzaA__AGR50088

SEQ ID NO: 84770 - RNA, 1410 nt, Artificial Sequence; identical to SEQ ID NO: 77736
  derived and/or modified sequence opt1 from neuraminidase__InfluenzaA__AGR50099

SEQ ID NO: 84771 - RNA, 1410 nt, Artificial Sequence; identical to SEQ ID NO: 77736
  derived and/or modified sequence opt1 from neuraminidase__InfluenzaA__AGR50110

SEQ ID NO: 84772 - RNA, 1410 nt, Artificial Sequence
  derived and/or modified sequence opt1 from neuraminidase__InfluenzaA__AGR50121
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccgugcccuccaacggggccaacggcgucaagggguucagcuucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggagcuucguccagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 84773 - RNA, 1410 nt, Artificial Sequence
  derived and/or modified sequence opt1 from neuraminidase__InfluenzaA__AGR50132
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgccaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 84774 - RNA, 1410 nt, Artificial Sequence; identical to SEQ ID NO: 77736
  derived and/or modified sequence opt1 from neuraminidase__InfluenzaA__AGR50143

SEQ ID NO: 84775 - RNA, 1410 nt, Artificial Sequence; identical to SEQ ID NO: 77736
  derived and/or modified sequence opt1 from neuraminidase__InfluenzaA__AGR50154

SEQ ID NO: 84776 - RNA, 1413 nt, Artificial Sequence; identical to SEQ ID NO: 79938
  derived and/or modified sequence opt1 from neuraminidase__InfluenzaA__AGR50165

SEQ ID NO: 84777 - RNA, 1410 nt, Artificial Sequence; identical to SEQ ID NO: 77736
  derived and/or modified sequence opt1 from neuraminidase__InfluenzaA__AGR50177

SEQ ID NO: 84778 - RNA, 1410 nt, Artificial Sequence; identical to SEQ ID NO: 77736
  derived and/or modified sequence opt1 from neuraminidase__InfluenzaA__AGR50188

SEQ ID NO: 84779 - RNA, 1410 nt, Artificial Sequence; identical to SEQ ID NO: 77736
  derived and/or modified sequence opt1 from neuraminidase__InfluenzaA__AGR50199

SEQ ID NO: 84780 - RNA, 1410 nt, Artificial Sequence; identical to SEQ ID NO: 77736
  derived and/or modified sequence opt1 from neuraminidase__InfluenzaA__AGR50210

SEQ ID NO: 84781 - RNA, 1410 nt, Artificial Sequence; identical to SEQ ID NO: 77736
  derived and/or modified sequence opt1 from neuraminidase__InfluenzaA__AGR50221

SEQ ID NO: 84782 - RNA, 1410 nt, Artificial Sequence
  derived and/or modified sequence opt1 from neuraminidase__InfluenzaA__AGR50232
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacagcaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccgaacaacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 84783 - RNA, 1410 nt, Artificial Sequence; identical to SEQ ID NO: 77736
  derived and/or modified sequence opt1 from neuraminidase__InfluenzaA__AGR50243

SEQ ID NO: 84784 - RNA, 1410 nt, Artificial Sequence; identical to SEQ ID NO: 77736
  derived and/or modified sequence opt1 from neuraminidase__InfluenzaA__AGR50254

SEQ ID NO: 84785 - RNA, 1410 nt, Artificial Sequence; identical to SEQ ID NO: 77736
  derived and/or modified sequence opt1 from neuraminidase__InfluenzaA__AGR50265

SEQ ID NO: 84786 - RNA, 1410 nt, Artificial Sequence
  derived and/or modified sequence opt1 from neuraminidase__InfluenzaA__AGR50276
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacagcucccucugcccggucagcgggugggccaucuacuccaaggacaacagcgugcgcaucggcuccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacgggccguccaacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucagcaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 84787 - RNA, 1410 nt, Artificial Sequence; identical to SEQ ID NO: 77736
  derived and/or modified sequence opt1 from neuraminidase__InfluenzaA__AGR50287

SEQ ID NO: 84788 - RNA, 1410 nt, Artificial Sequence
  derived and/or modified sequence opt1 from neuraminidase__InfluenzaA__AGR50298
augaaccccaaccagaagaucaucaccaucggcagcgugugcaugaccaucgggauggccaaccugauccuccagaucggcaacacgaucuccaucuggaucagccacuccauccagccggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacagcucccugugccccgucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggacgaucaaggaccgguccccguaccgcacccugaugagcugccccaucggcgagguccccucccccuacaacagccgguucgagagcguggccugguccgcgagcgccugccacgacgggaucaacuggcugaccaucggcaucuccggcccggacaacggggccguggccguccucaaguacaacggcaucaucaccgacacgaucaagagcuggcgcaacaacauccugcggacccaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgcccgugggucagcuucaaccagaaccuggaguaccagaucggguacaucugcuccggcaucuucggggacaacccccggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggacccgaacggguggaccggcacggacaacaacuucagcaucaagcaggacaucguggggaucaacgagugguccggcuacagcggguccuucgugcagcaccccgagcucaccggccuggacugcauccgccccugcuucugggucgagcugauccggggccgccccaaggagaacaccaucuggaccagcggguccagcaucuccuucugcggcgugaacagcgacacggucgggugguccuggccggacggcgccgagcuccccuucaccaucgacaaguga

SEQ ID NO: 84789 - RNA, 1410 nt, Artificial Sequence; identical to SEQ ID NO: 77736
  derived and/or modified sequence opt1 from neuraminidase__InfluenzaA__AGR50309

SEQ ID NO: 84790 - RNA, 1410 nt, Artificial Sequence; identical to SEQ ID NO: 77736
  derived and/or modified sequence opt1 from neuraminidase__InfluenzaA__AGR50320

SEQ ID NO: 84791 - RNA, 1410 nt, Artificial Sequence; identical to SEQ ID NO: 77736
  derived and/or modified sequence opt1 from neuraminidase__InfluenzaA__AGR50331

SEQ ID NO: 84792 - RNA, 1410 nt, Artificial Sequence
  derived and/or modified sequence opt1 from neuraminidase__InfluenzaA__AGR50342
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacagcucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84793 - RNA, 1410 nt, Artificial Sequence; identical to SEQ ID NO: 77736
  derived and/or modified sequence opt1 from neuraminidase__InfluenzaA__AGR50353

SEQ ID NO: 84794 - RNA, 1413 nt, Artificial Sequence; identical to SEQ ID NO: 79938
  derived and/or modified sequence opt1 from neuraminidase__InfluenzaA__AGR50364

SEQ ID NO: 84795 - RNA, 1410 nt, Artificial Sequence
  derived and/or modified sequence opt1 from neuraminidase__InfluenzaA__AGR55170
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaucaaccgccagaucaucgucgaccggggcaaccgcagcggguacuccggcaucuucagcguggagggcaagagcugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 84796 - RNA, 1410 nt, Artificial Sequence; identical to SEQ ID NO: 75153
  derived and/or modified sequence opt1 from neuraminidase__InfluenzaA__AGR55180

SEQ ID NO: 84797 - RNA, 1410 nt, Artificial Sequence; identical to SEQ ID NO: 75153
  derived and/or modified sequence opt1 from neuraminidase__InfluenzaA__AGR55181

SEQ ID NO: 84798 - RNA, 1410 nt, Artificial Sequence; identical to SEQ ID NO: 75153
  derived and/or modified sequence opt1 from neuraminidase__InfluenzaA__AGR55183

SEQ ID NO: 84799 - RNA, 1410 nt, Artificial Sequence
  derived and/or modified sequence opt1 from neuraminidase__InfluenzaA__AGR55184
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaagaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccuccgggaccuacggcacggggagcuggccggacggcgccgacaucaaccugaugcccaucuga

SEQ ID NO: 84800 - RNA, 1410 nt, Artificial Sequence
  derived and/or modified sequence opt1 from neuraminidase__InfluenzaA__AGR55185
augaaccccaaccagaagaucaucaccaucggcagcgugucccugaccaucgccacgaucugcuuccucaugcagaucgccauccuggucaccaccgugacccugcacuucaagcagcacgagugcaacagcccgcccaagaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccagcuccagcugccacgacggcaaggcguggcugcacgucugcgugaccggggacgacaagaacgccaccgccuccuucaucuacaacggccggcugguggacagcaucggguccuggagcaagaagauccuccgcacccaggaguccgagugcgucugcaucaacggcacgugcaccguggugaugaccgacggcagcgccuccgggaaggcggacaccaagauccuguucaucgaggagggcaagaucguccacaucagcacgcugagcggguccgcccagcacguggaggagugcagcugcuacccccgguaccccggcgugcgcugcgucugccgggacaacuggaagggcuccaaccgcccgaucguggacaucaacgugaaggacuacagcaucgucuccagcuacgugugcuccgggcucgugggcgacacgccccggaagaacgacagcuucuccagcucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggagcaagcccaacuccaagcuccagaucaaccgccaggugaucguggagcggggcaaccgcagcggguacuccggcaucuucagcgucgagggcaaguccugcaucaaccggugcuucuacguggagcugauccgcgggcggaaggaggagaccgaggugugguggaccagcaacagcaucgucguguucugcggcaccucccgcaccuacgggacgggcagcuggccggacggggccgacaucaaccugaugcccaucuga

SEQ ID NO: 84801 - RNA, 1410 nt, Artificial Sequence
  derived and/or modified sequence opt1 from neuraminidase__InfluenzaA__AGR55186
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaagaagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgagcccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 84802 - RNA, 1410 nt, Artificial Sequence; identical to SEQ ID NO: 75153
  derived and/or modified sequence opt1 from neuraminidase__InfluenzaA__AGR55187

SEQ ID NO: 84803 - RNA, 1410 nt, Artificial Sequence; identical to SEQ ID NO: 75722
  derived and/or modified sequence opt1 from neuraminidase__InfluenzaA__AGR55192

SEQ ID NO: 84804 - RNA, 1410 nt, Artificial Sequence
  derived and/or modified sequence opt1 from neuraminidase__InfluenzaA__AGR55195
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgaccacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 84805 - RNA, 1410 nt, Artificial Sequence
  derived and/or modified sequence opt1 from neuraminidase__InfluenzaA__AGR55204
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcgaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccucccgcacguacgggaccggcagcuggccggacggggccgacaucaaccugaugcccaucuga

SEQ ID NO: 84806 - RNA, 1410 nt, Artificial Sequence
  derived and/or modified sequence opt1 from neuraminidase__InfluenzaA__AGR55218
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 84807 - RNA, 1410 nt, Artificial Sequence; identical to SEQ ID NO: 84397
  derived and/or modified sequence opt1 from neuraminidase__InfluenzaA__AGT18726

SEQ ID NO: 84808 - RNA, 1410 nt, Artificial Sequence
  derived and/or modified sequence opt1 from neuraminidase__InfluenzaA__AGT18727
augaaccccaaccagaagaucaucaccaucggcagcgugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggagcggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 84809 - RNA, 1410 nt, Artificial Sequence; identical to SEQ ID NO: 84397
  derived and/or modified sequence opt1 from neuraminidase__InfluenzaA__AGT18728

SEQ ID NO: 84810 - RNA, 1410 nt, Artificial Sequence
  derived and/or modified sequence opt1 from neuraminidase__InfluenzaA__AGT18729
augaaccccaaccagaagaucaucaccaucggccaggugugcaugaccaucgggauggccaaccugauccuccagaucggcaacaucaucagcaucuggaucucccacagcauccagcuggggucccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacagcggggccgucgccgugcugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 84811 - RNA, 1410 nt, Artificial Sequence
  derived and/or modified sequence opt1 from neuraminidase__InfluenzaA__AGT18730
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 84812 - RNA, 1410 nt, Artificial Sequence; identical to SEQ ID NO: 84397
  derived and/or modified sequence opt1 from neuraminidase__InfluenzaA__AGT18731

SEQ ID NO: 84813 - RNA, 1410 nt, Artificial Sequence
  derived and/or modified sequence opt1 from neuraminidase__InfluenzaA__AGT18732
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucagcuucaaguacggcaacggggucuggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggacccgggggagcuccaucagcuucugcggcgugaacuccgacaccgucggguggagcuggcccgacggcgccgagcugccguucacgaucgacaaguga

SEQ ID NO: 84814 - RNA, 1410 nt, Artificial Sequence
  derived and/or modified sequence opt1 from neuraminidase__InfluenzaA__AGT18733
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccguggccuggagcgcguccgccugccacgacgggaucaacuggcucaccaucggcaucagcggccccgacuccggggccgucgccgugcugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgucaaguccguggagaugaacgcccccaacuaccacuacgaggagugcagcugcuaccccgacuccagcgaguccacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcagcaacggggccaacggcgugaagggguucuccuucaaguacggcaacggggucuggaucggccgcaccaagagcaucuccagccggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcucccggagcuucugcggcgugaacuccgacaccgucggguggagcuggcccgacggcgccgagcugccguucacgaucgacaaguga

SEQ ID NO: 84815 - RNA, 1410 nt, Artificial Sequence
  derived and/or modified sequence opt1 from neuraminidase__InfluenzaA__AGT18762
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugacgcugugcgagcccaucaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84816 - RNA, 1410 nt, Artificial Sequence
  derived and/or modified sequence opt1 from neuraminidase__InfluenzaA__AGT18764
augaaccccaaccagaugaucaucaccaucggcagcgugucccugaccagcuccacgaucugcuucuucaugcagaccgccagcuucaucaccaccgucacgcuccacaucaagcagcacgaguuccacuccccgcccaacaaccaggugaugcugugcgagcccaccaucaucgagcgcaacaucaccgagaucguguaccugaccaacacgaccaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccugggccaggggacgacccucaacaacgugcacuccaacaacaccguccgcgaccggaccccguaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggaagcucguggacuccguggucagcugguccaaggagauccugcggacgcaggagagcgagugcgugugcaucaacgggaccugcaccguggucaugaccgacgggagcgccuccggcaaggccgacacgaagauccuguucaucgaggagggcaagaucgugcacaccagcacccucuccgggagcgcgcagcacguggaggagugcuccugcuacccccgcuaccccggcguccggugcgugugccgcgacaacuggaaggggagcaaccggccgaucguggacaucaacaugaaggaccacuccaucgucagcuccuacgugugcagcggccuggugggcgacacgccccgcaagaacgaccgguccagcaacucccacugccuggaccccaacaacgaggagggcggccacggggucaagggcugggccuucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggccggacggcgccgaccugaaccugaugcccaucuga

SEQ ID NO: 84817 - RNA, 1410 nt, Artificial Sequence
  derived and/or modified sequence opt1 from neuraminidase__InfluenzaA__AGT18765
augaaccccaaccagaagaucaucaccaucggcagcgugucccugaccaucagcacgaucugcuucuucaugcagaucgccauccucaucaccaccgucacccugcacuucaagcagcacgaguuccacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccuggugggcgacacgccccggaagaacgaccgcuccagcaacucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccuccaacagcaucgucguguucugcggcacgagcgggaccuacggcaccggguccuggccggacggcgccgaccugaaccucaugcccaucuga

SEQ ID NO: 84818 - RNA, 1410 nt, Artificial Sequence
  derived and/or modified sequence opt1 from neuraminidase__InfluenzaA__AGT18766
augaaccccaaccagaagaucaucaccaucggcagcgugucccugaccaucagcacgaucugccucuucaugcagaucgccauccugaucaccaccgucacccugcacuucaagcagcacgaguuccacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaugaaggaccacuccaucgucagcuccuacgugugcagcggccucgugggcgacacgccccggaagaacgaccgcuccagcaacucccacugccuggaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccuccaacagcaucgucguguucugcggcacgagcgggaccuacggcaccggguccuggccggacggcgccgaccucaaccugaagcccaucuga

SEQ ID NO: 84819 - RNA, 1410 nt, Artificial Sequence
  derived and/or modified sequence opt1 from neuraminidase__InfluenzaA__AGT18767
augaaccccaaccagaagaucaucaccaucggcagcgugucccugaccaucagcacgaucugcuucuucaugcagaccgccucccucaucaccaccgucacgcugcacuucaagcagcacgaguuccacagcccgcccaacaaccaggugaugcugugcgagcccaccaucaucgagcgcaacaucaccgagaucguguaccucaccaacacgaccaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggacgacccugaacaacgugcacagcaacaacaccguccgcgaccggaccccguaccgcacgcugcucaugaacgagcugggcgugcccuuccaccugggcaccaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacgcaggaguccgagugcgugugcaucaacgggaccugcaccguggucaugaccgacgggagcgccagcggcaaggccgacacgaagauccucuucaucgaggagggcaagaucgugcacaccuccacccugagcggguccgcgcagcacguggaggagugcagcugcuacccccgguaccccggcguccgcugcgugugccgggacaacuggaagggguccaaccgcccgaucguggacaucaacaugaaggaccacagcaucgucuccagcuacgugugcuccggccuggugggcgacacgccccggaagaacgaccgcagcuccaacagccacugccucgaccccaacaacgaggagggcggccacggggucaagggcugggccuucgacgacgggaacgacguguggaugggccggaccaucaacgagaccucccgccugggcuacgagaccuucaaggucaucgagggguggagcaaccccaaguccaagcugcagaucaaccgccaggugaucguggaccggggcaaccggagcggguacuccggcaucuucagcgucgaggggaaguccugcaucaaccgcugcuucuacguggagcucauccggggccgcaaggaggagaccgaggugcuguggacgagcaacagcaucgucguguucugcggcaccuccgggaccuacggcaccgggagcuggccggacggcgccgaccugaaccucaugcccaucuga

SEQ ID NO: 84820 - RNA, 1410 nt, Artificial Sequence
  derived and/or modified sequence opt1 from neuraminidase__InfluenzaA__AGT18768
augaaccccaaccagaagaucaucaccaucggcagcgugucccugaccaucagcacgaucugcuucuucaugcagaccgccuccuucaucaccaccgucacgcuccacuucaagcaguacgaguucaacagcccgcccaacaaccaggugaugcugugcgagcccaccaucaucgagcgcaacaucaccgagaucguguaccugaccaacacgaccaucgagaaggagaucugccccaagcucgccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccugggccaggggacgacccucaacaacgugcacagcaacaacaccguccgcgaccggaccccguaccgcacgcugcugaugaacgagcucggcgugcccuuccaccugggcaccaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacgcaggaguccgagugcgugugcaucaacgggaccugcaccguggucaugaccgacgggagcgccagcggcaaggccgacacgaagauccuguucaucgaggagggcaagaucgugcacaccuccacccucagcggguccgcgcagcacguggaggagugcagcugcuacccccgguaccccggcguccgcugcgugugccgggacaacuggaagggguccaaccgcccgaucguggacaucaacaugaaggaccacagcaucgucuccagcuacgugugcuccggccuggugggcgacacgccccggaagaacgaccgcagcuccaacagccacugccuggaccccaacaacgaggagggcggccacggggucaagggcugggccuucgacgacgggaacgacguguggaugggccggaccaucaacgagaccucccgccucggcuacgagaccuucaaggucaucgagggguggagcaaccccaaguccaagcugcagaucaaccgccaggugaucguggaccggggcaaccggagcggguacuccggcaucuucagcgucgaggggaaguccugcaucaaccgcugcuucuacguggagcugauccggggccgcaaggaggagaccgaggugcucuggacgagcaacagcaucgucguguucugcggcaccuccgggaccuacggcaccgggagcuggccggacggcgccgaccugaaccugaugcccaucuga

SEQ ID NO: 84821 - RNA, 1410 nt, Artificial Sequence; identical to SEQ ID NO: 83154
  derived and/or modified sequence opt1 from neuraminidase__InfluenzaA__AGT18769

SEQ ID NO: 84822 - RNA, 1410 nt, Artificial Sequence
  derived and/or modified sequence opt1 from neuraminidase__InfluenzaA__AGT18770
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaacaaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84823 - RNA, 1410 nt, Artificial Sequence
  derived and/or modified sequence opt1 from neuraminidase__InfluenzaA__AGT18771
augaaccccaaccagaagaucaucaccaucggcagcgugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84824 - RNA, 1410 nt, Artificial Sequence; identical to SEQ ID NO: 83154
  derived and/or modified sequence opt1 from neuraminidase__InfluenzaA__AGT18772

SEQ ID NO: 84825 - RNA, 1410 nt, Artificial Sequence
  derived and/or modified sequence opt1 from neuraminidase__InfluenzaA__AGT37104
augaaccccaaccagaagaucaucaccaucggcagcgugucccugaccaucgccacgaucugccuccugaugcagaucgccauccuggucaccaccgugacccuccacuucaagcaguacgagugcagcuccccgcccaacaaccaggugaugcccugcgagcccacgaucaucgagcgcaacaucaccaagaucgucuaccugaccaacaccacgaucgagcgggaggcgugcccggagcuggccgaguaccgccacuggagcaagccccagugcaagauccggggguucgcccccuucuccaaggacaacagcauccgccucuccgccggcggggacaucugggugacccgggagcccuacgugagcugcgacccgggcaagugcuaccaguucgcccuggggcagggcaccacccugaacaaccgccacuccaacgacacgguccacgaccggacccccuaccgcacccuccugaugaacgagcugggcgugcccuuccaccucgggaccaagcaggucugcaucgcguggagcuccagcuccugccacgacggcaaggccuggcugcacgugugcaucacggggcacgacaagaacgccaccgccagcuucaucuacgacggccggcugguggacuccaucgggagcuggucccagaacauccuccgcacccaggagagcgagugcgugugcaucaacgggaccugcacggucgugaugaccgacggcuccgcgagcgggcgggccgacaccaagaucauguucguggaggagggcaagaucguccacaucagcccccuggccggguccgcccagcacguggaggagugcagcugcuacccgaaguaccccggcgugcgcugcgucugccgggacaacuggaagggcuccaaccgccccaucguggacaucaacaugaaggacuacagcaucguguccagcuacgucugcuccgggcuggugggcgacacgccccggcgcaacgacagcuccagcaccuccuacugccucaacccgaacaacgaggagggcggccacggggugaagggcugggccuucgacgacggcgacgacgucuggauggggcggaccaucagcgagaagcugcgccugggcuacgagaccuucaaggugaucgggggcugguccaagcccaacagcaagcuccagaucaaccggcaggucgugguggacaucuccaaccgcagcggguacuccggcaucuucagcgucgagggcaaguccugcaucaaccggugcuucuacguggagcugauccgcgggcgcaagcaggagaacgaggugugguggaccagcaacagcaucgucguguucugcggcacguccgggaccuacggcaccgggagcuggcccgacggcgcggacaucaaccugaugcccaucuga

SEQ ID NO: 84826 - RNA, 1410 nt, Artificial Sequence
  derived and/or modified sequence opt1 from neuraminidase__InfluenzaA__AGU69973
augaaccccaaccagaagaucaucaccaucggcagcgugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucagcgccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccagcuccagcugccacgacggcaaggcguggcugcacgugugcgugaccggggacgacgagaacgccaccgccuccuucaucuacaacggccgccugguggacagcaucggguccuggagcaagaagauccuccggacccaggaguccgagugcgucugcaucaacggcacgugcaccguggugaugaccgacggcagcgccuccgggaaggcggacaccaagauccuguucaucgaggagggcaagaucguccacacgagcccccugagcggguccgcccagcacguggaggagugcagcugcuacccccgcuacccgggcgugcggugcgucugccgcgacaacuggaagggcuccaaccggcccaucguggacaucaacgugaaggacuacagcaucgucuccagcuacgugcgcuccgggcucgugggcgacacgccccggaagaacgacagcuccagcuccagccacugccuggaccccaacaacgaggagggcgggcacggggucaagggcugggccuucgacgacggcaacgacguguggauggggcgcaccaucuccgagaagucccggagcggcuacgagaccuucaaggucaucgagggguggagcaagccgaacuccaagcugcagaucaaccgccaggugaucguggaccggggcaaccgcagcggguacuccggcaucuucagcgucgagggcaagagcugcaucaaccggugcuucuacguggagcucauccgcgggggcaagcaggagaccgaggugcuguggaccuccaacagcaucgucguguucugcgggaccuccggcaccuacgggacgggcagcuggcccgacggcgccgaccugaaccucaugcccaucuga

SEQ ID NO: 84827 - RNA, 1410 nt, Artificial Sequence
  derived and/or modified sequence opt1 from neuraminidase__InfluenzaA__AGU92648
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 84828 - RNA, 1410 nt, Artificial Sequence
  derived and/or modified sequence opt1 from neuraminidase__InfluenzaA__AGU92670
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcaccaucaaggaccgcagccccuaccggacgcugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacaccaucaaguccuggcggaacaacauccugcgcacgcaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcagcgggaucuucggcgacaacccgcgccccgacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacacgaucuggaccuccggcagcuccaucagcuucugcggggucaacuccgacaccgugggcuggagcuggcccgacggggccgagcugccguucaccaucgacaaguga

SEQ ID NO: 84829 - RNA, 1410 nt, Artificial Sequence
  derived and/or modified sequence opt1 from neuraminidase__InfluenzaA__AGU92681
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaccuacagcaaggacaacuccauccggaucggcagcaagggcgacguguucgugauccgcgagcccuucaucuccugcagcccccuggagugccggaccuucuuccugacccagggggcccuccugaacgacaagcacuccaacggcacgaucaaggaccgcagccccuaccggacccugauguccugcccgaucggggagguccccagccccuacaacagccgcuucgaguccguggccuggagcgcguccgccugccacgacggcaucaacuggcucaccaucgggaucagcggccccgacaacggcgccguggccguccugaaguacaacgggaucaucaccgacacgaucaaguccuggcggaacaacauccugcgcacccaggagagcgagugcgcgugcgugaacggcuccugcuucaccaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcagcgggaucuucggcgacaacccgcgccccaacgacaagacgggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggaccgggaccgacaacaacuucuccaucaagcaggacaucgucggcaucaacgaguggagcggguacuccggcagcuucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 84830 - RNA, 1410 nt, Artificial Sequence
  derived and/or modified sequence opt1 from neuraminidase__InfluenzaA__AGU92692
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucauccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 84831 - RNA, 1410 nt, Artificial Sequence; identical to SEQ ID NO: 84830
  derived and/or modified sequence opt1 from neuraminidase__InfluenzaA__AGU92703

SEQ ID NO: 84832 - RNA, 1410 nt, Artificial Sequence; identical to SEQ ID NO: 84830
  derived and/or modified sequence opt1 from neuraminidase__InfluenzaA__AGU92714

SEQ ID NO: 84833 - RNA, 1410 nt, Artificial Sequence; identical to SEQ ID NO: 84830
  derived and/or modified sequence opt1 from neuraminidase__InfluenzaA__AGU92725

SEQ ID NO: 84834 - RNA, 1410 nt, Artificial Sequence; identical to SEQ ID NO: 84830
  derived and/or modified sequence opt1 from neuraminidase__InfluenzaA__AGU92736

SEQ ID NO: 84835 - RNA, 1410 nt, Artificial Sequence; identical to SEQ ID NO: 84830
  derived and/or modified sequence opt1 from neuraminidase__InfluenzaA__AGU92747

SEQ ID NO: 84836 - RNA, 1410 nt, Artificial Sequence; identical to SEQ ID NO: 84830
  derived and/or modified sequence opt1 from neuraminidase__InfluenzaA__AGU92758

SEQ ID NO: 84837 - RNA, 1410 nt, Artificial Sequence; identical to SEQ ID NO: 84827
  derived and/or modified sequence opt1 from neuraminidase__InfluenzaA__AGU92769

SEQ ID NO: 84838 - RNA, 1410 nt, Artificial Sequence; identical to SEQ ID NO: 84827
  derived and/or modified sequence opt1 from neuraminidase__InfluenzaA__AGU92780

SEQ ID NO: 84839 - RNA, 1410 nt, Artificial Sequence
  derived and/or modified sequence opt1 from neuraminidase__InfluenzaA__AGU92791
augaaccccaaccagaagaucaucaccaucggcagcgugugcaugaccaucgggauggccaaccugauccuccagaucggcaacaucaucuccaucuggaucagccacuccauccagcugcgcaaccagagccagaucgagacgugcaaccaguccgucaucaccuacgagaacaacaccugggugaaccagaccuacgugaacaucagcaacacgaacuucgccgcggggcaguccgucgugagcgugaagcuggccggcaacuccagccucugcccggucuccgggugggccaucuacagcaaggacaacuccauccggaucggcagcaagggcgacguguucgugauccgcgagcccuucaucuccugcagcccccuggagugccggaucuucuuccugacccagggggcccuccugaacgacaagcacuccaacggcaccaucaaggaccgcagccccuaccggacccugauguccugcccgaucggggagguccccagccccuacaacagccgcuucgaguccguggccuggagcgcguccgccugccacgacggcaucaacuggcucacgaucgggaucagcggccccgacaacggcgccguggccguccugaaguacaacgggaucaucaccgacaccaucaaguccuggcggaacaacauccugcgcacccaggagagcgagugcgcgugcgugaacggcuccugcuucacgaucaugaccgacgggccgagcgacggccaggccuccuacaagaucuuccggaucgagaagggcaagaucgucaagagcguggagaugaacgcccccaacuaccacuacgaggagugcuccugcuaccccgacagcuccgagaucaucugcgugugccgcgacaacuggcacgggagcaaccggcccuggguguccuucaaccagaaccucgaguaccagaucggcuacaucugcagcgggaucuucggcgacaacccgcgccccaacgacaagaccggguccugcggccccgucagcuccaacggcgccaacggggugaagggcuucagcuucaaguacgggaacggcguguggaucgggcggaccaagagcaucuccagccgcaagggcuucgagaugaucugggaccccaacggcuggacggggaccgacaacaacuucuccaucaagcaggacaucgucggcaucaacgaguggagcggguacuccggcagcuucgugcagcacccggagcugaccgggcuggacugcauccggcccugcuucuggguggagcucauccgcggccggcccaaggagaacaccaucuggacguccggcagcuccaucagcuucugcggggucaacuccgacaccgugggcuggagcuggcccgacggggccgagcugccguucaccaucgacaaguga

SEQ ID NO: 84840 - RNA, 1410 nt, Artificial Sequence; identical to SEQ ID NO: 84827
  derived and/or modified sequence opt1 from neuraminidase__InfluenzaA__AGU92802

SEQ ID NO: 84841 - RNA, 1410 nt, Artificial Sequence; identical to SEQ ID NO: 84827
  derived and/or modified sequence opt1 from neuraminidase__InfluenzaA__AGU92813

SEQ ID NO: 84842 - RNA, 1410 nt, Artificial Sequence; identical to SEQ ID NO: 84827
  derived and/or modified sequence opt1 from neuraminidase__InfluenzaA__AGU92824

SEQ ID NO: 84843 - RNA, 1410 nt, Artificial Sequence
  derived and/or modified sequence opt1 from neuraminidase__InfluenzaA__AGU92846
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucgccuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggagcuucauccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 84844 - RNA, 1410 nt, Artificial Sequence
  derived and/or modified sequence opt1 from neuraminidase__InfluenzaA__AGU92868
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucagcggcugggccaucuacuccaaggacaacagcgugcgcgugggcuccaagggggacgucuucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcugaccaucggcaucuccggccccgacaacggggccguggccgugcucaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucauccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 84845 - RNA, 1410 nt, Artificial Sequence
  derived and/or modified sequence opt1 from neuraminidase__InfluenzaA__AGU92890
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccgagaccgacaacaacuucagcaucaagcaggacaucgucggcaucaacgagugguccggguacagcggcuccuucauccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 84846 - RNA, 1410 nt, Artificial Sequence; identical to SEQ ID NO: 84827
  derived and/or modified sequence opt1 from neuraminidase__InfluenzaA__AGU92901

SEQ ID NO: 84847 - RNA, 1410 nt, Artificial Sequence; identical to SEQ ID NO: 84827
  derived and/or modified sequence opt1 from neuraminidase__InfluenzaA__AGU92912

SEQ ID NO: 84848 - RNA, 1410 nt, Artificial Sequence; identical to SEQ ID NO: 84827
  derived and/or modified sequence opt1 from neuraminidase__InfluenzaA__AGU92923

SEQ ID NO: 84849 - RNA, 1410 nt, Artificial Sequence; identical to SEQ ID NO: 84830
  derived and/or modified sequence opt1 from neuraminidase__InfluenzaA__AGU92934

SEQ ID NO: 84850 - RNA, 1410 nt, Artificial Sequence; identical to SEQ ID NO: 84830
  derived and/or modified sequence opt1 from neuraminidase__InfluenzaA__AGU92945

SEQ ID NO: 84851 - RNA, 1410 nt, Artificial Sequence; identical to SEQ ID NO: 84830
  derived and/or modified sequence opt1 from neuraminidase__InfluenzaA__AGU92956

SEQ ID NO: 84852 - RNA, 1410 nt, Artificial Sequence; identical to SEQ ID NO: 84827
  derived and/or modified sequence opt1 from neuraminidase__InfluenzaA__AGU92967

SEQ ID NO: 84853 - RNA, 1410 nt, Artificial Sequence; identical to SEQ ID NO: 84827
  derived and/or modified sequence opt1 from neuraminidase__InfluenzaA__AGU92978

SEQ ID NO: 84854 - RNA, 1410 nt, Artificial Sequence
  derived and/or modified sequence opt1 from neuraminidase__InfluenzaA__AGU92989
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 84855 - RNA, 1410 nt, Artificial Sequence; identical to SEQ ID NO: 84844
  derived and/or modified sequence opt1 from neuraminidase__InfluenzaA__AGU93000

SEQ ID NO: 84856 - RNA, 1410 nt, Artificial Sequence; identical to SEQ ID NO: 84845
  derived and/or modified sequence opt1 from neuraminidase__InfluenzaA__AGU93011

SEQ ID NO: 84857 - RNA, 1365 nt, Artificial Sequence; identical to SEQ ID NO: 81398
  derived and/or modified sequence opt1 from neuraminidase__InfluenzaA__AGU93022

SEQ ID NO: 84858 - RNA, 1410 nt, Artificial Sequence
  derived and/or modified sequence opt1 from neuraminidase__InfluenzaA__AGU93034
augaaccccacccagaagaucaucaccaucggcagcgugugcaugacgaucgggauggccaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucgccuccgugaagcuggccgggaacagcucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcacggacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgugaacagcgacacggucgggugguccuggcccgacggcgcggagcugccguucaccaucgacaaguga

SEQ ID NO: 84859 - RNA, 1410 nt, Artificial Sequence; identical to SEQ ID NO: 84166
  derived and/or modified sequence opt1 from neuraminidase__InfluenzaA__AGU93045

SEQ ID NO: 84860 - RNA, 1410 nt, Artificial Sequence; identical to SEQ ID NO: 84827
  derived and/or modified sequence opt1 from neuraminidase__InfluenzaA__AGU93056

SEQ ID NO: 84861 - RNA, 1410 nt, Artificial Sequence; identical to SEQ ID NO: 83154
  derived and/or modified sequence opt1 from neuraminidase__InfluenzaA__AGV98980

SEQ ID NO: 84862 - RNA, 1410 nt, Artificial Sequence; identical to SEQ ID NO: 83154
  derived and/or modified sequence opt1 from neuraminidase__InfluenzaA__AGV98993

SEQ ID NO: 84863 - RNA, 1410 nt, Artificial Sequence; identical to SEQ ID NO: 83154
  derived and/or modified sequence opt1 from neuraminidase__InfluenzaA__AGV99005

SEQ ID NO: 84864 - RNA, 1410 nt, Artificial Sequence; identical to SEQ ID NO: 83154
  derived and/or modified sequence opt1 from neuraminidase__InfluenzaA__AGV99017

SEQ ID NO: 84865 - RNA, 1410 nt, Artificial Sequence; identical to SEQ ID NO: 83154
  derived and/or modified sequence opt1 from neuraminidase__InfluenzaA__AGV99040

SEQ ID NO: 84866 - RNA, 1410 nt, Artificial Sequence
  derived and/or modified sequence opt1 from neuraminidase__InfluenzaA__AGV99052
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccgucaucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84867 - RNA, 1410 nt, Artificial Sequence
  derived and/or modified sequence opt1 from neuraminidase__InfluenzaA__AGV99100
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcgugaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 84868 - RNA, 1410 nt, Artificial Sequence; identical to SEQ ID NO: 83154
  derived and/or modified sequence opt1 from neuraminidase__InfluenzaA__AGV99112

SEQ ID NO: 84869 - RNA, 1410 nt, Artificial Sequence; identical to SEQ ID NO: 83154
  derived and/or modified sequence opt1 from neuraminidase__InfluenzaA__AGV99124

SEQ ID NO: 84870 - RNA, 1410 nt, Artificial Sequence; identical to SEQ ID NO: 83154
  derived and/or modified sequence opt1 from neuraminidase__InfluenzaA__AGV99136

SEQ ID NO: 84871 - RNA, 1410 nt, Artificial Sequence; identical to SEQ ID NO: 83154
  derived and/or modified sequence opt1 from neuraminidase__InfluenzaA__AGV99148

SEQ ID NO: 84872 - RNA, 1410 nt, Artificial Sequence; identical to SEQ ID NO: 83154
  derived and/or modified sequence opt1 from neuraminidase__InfluenzaA__AGV99160

SEQ ID NO: 84873 - RNA, 1410 nt, Artificial Sequence; identical to SEQ ID NO: 83154
  derived and/or modified sequence opt1 from neuraminidase__InfluenzaA__AGV99172

SEQ ID NO: 84874 - RNA, 1410 nt, Artificial Sequence; identical to SEQ ID NO: 83154
  derived and/or modified sequence opt1 from neuraminidase__InfluenzaA__AGV99196

SEQ ID NO: 84875 - RNA, 1410 nt, Artificial Sequence; identical to SEQ ID NO: 83154
  derived and/or modified sequence opt1 from neuraminidase__InfluenzaA__AGV99208

SEQ ID NO: 84876 - RNA, 1410 nt, Artificial Sequence; identical to SEQ ID NO: 83154
  derived and/or modified sequence opt1 from neuraminidase__InfluenzaA__AGV99959

SEQ ID NO: 84877 - RNA, 1410 nt, Artificial Sequence; identical to SEQ ID NO: 84365
  derived and/or modified sequence opt1 from neuraminidase__InfluenzaA__AGW00005

SEQ ID NO: 84878 - RNA, 1410 nt, Artificial Sequence; identical to SEQ ID NO: 83154
  derived and/or modified sequence opt1 from neuraminidase__InfluenzaA__AGW00068

SEQ ID NO: 84879 - RNA, 1410 nt, Artificial Sequence
  derived and/or modified sequence opt1 from neuraminidase__InfluenzaA__AGW00080
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84880 - RNA, 1410 nt, Artificial Sequence
  derived and/or modified sequence opt1 from neuraminidase__InfluenzaA__AGW00104
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcgaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84881 - RNA, 1410 nt, Artificial Sequence; identical to SEQ ID NO: 84879
  derived and/or modified sequence opt1 from neuraminidase__InfluenzaA__AGW00116

SEQ ID NO: 84882 - RNA, 1410 nt, Artificial Sequence; identical to SEQ ID NO: 84879
  derived and/or modified sequence opt1 from neuraminidase__InfluenzaA__AGW00128

SEQ ID NO: 84883 - RNA, 1410 nt, Artificial Sequence; identical to SEQ ID NO: 83154
  derived and/or modified sequence opt1 from neuraminidase__InfluenzaA__AGW00140

SEQ ID NO: 84884 - RNA, 1410 nt, Artificial Sequence; identical to SEQ ID NO: 83154
  derived and/or modified sequence opt1 from neuraminidase__InfluenzaA__AGW00152

SEQ ID NO: 84885 - RNA, 1410 nt, Artificial Sequence; identical to SEQ ID NO: 84879
  derived and/or modified sequence opt1 from neuraminidase__InfluenzaA__AGW00164

SEQ ID NO: 84886 - RNA, 1410 nt, Artificial Sequence; identical to SEQ ID NO: 83154
  derived and/or modified sequence opt1 from neuraminidase__InfluenzaA__AGW00176

SEQ ID NO: 84887 - RNA, 1410 nt, Artificial Sequence; identical to SEQ ID NO: 83154
  derived and/or modified sequence opt1 from neuraminidase__InfluenzaA__AGW00188

SEQ ID NO: 84888 - RNA, 1410 nt, Artificial Sequence; identical to SEQ ID NO: 83154
  derived and/or modified sequence opt1 from neuraminidase__InfluenzaA__AGW00712

SEQ ID NO: 84889 - RNA, 1410 nt, Artificial Sequence; identical to SEQ ID NO: 83154
  derived and/or modified sequence opt1 from neuraminidase__InfluenzaA__AGW00724

SEQ ID NO: 84890 - RNA, 1410 nt, Artificial Sequence
  derived and/or modified sequence opt1 from neuraminidase__InfluenzaA__AGW00736
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggugacccgggagcccuacgucagcugcgacccggacaagugcuaccaguucgcccuggggcagggcaccacgcucaacaacgugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccgaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84891 - RNA, 1410 nt, Artificial Sequence
  derived and/or modified sequence opt1 from neuraminidase__InfluenzaA__AGW00748
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84892 - RNA, 1410 nt, Artificial Sequence
  derived and/or modified sequence opt1 from neuraminidase__InfluenzaA__AGW00760
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcuccaggugaaccgccaggugaucgucgaccgcggggaccgguccggcuacagcgggaucuucuccguggagggcaagagcugcaucaaccggugcuucuacguggagcugauccgcggccggaaggaggagaccgagguccuguggaccagcaacuccaucgugguguucugcgggacgagcggcaccuacgggaccggcuccuggcccgacggggccgaccugaaccugaugcccaucuga

SEQ ID NO: 84893 - RNA, 1410 nt, Artificial Sequence; identical to SEQ ID NO: 83154
  derived and/or modified sequence opt1 from neuraminidase__InfluenzaA__AGW00784

SEQ ID NO: 84894 - RNA, 1410 nt, Artificial Sequence; identical to SEQ ID NO: 83154
  derived and/or modified sequence opt1 from neuraminidase__InfluenzaA__AGW00796

SEQ ID NO: 84895 - RNA, 1410 nt, Artificial Sequence; identical to SEQ ID NO: 84879
  derived and/or modified sequence opt1 from neuraminidase__InfluenzaA__AGW00808

SEQ ID NO: 84896 - RNA, 1410 nt, Artificial Sequence; identical to SEQ ID NO: 84383
  derived and/or modified sequence opt1 from neuraminidase__InfluenzaA__AGW00820

SEQ ID NO: 84897 - RNA, 1410 nt, Artificial Sequence; identical to SEQ ID NO: 83154
  derived and/or modified sequence opt1 from neuraminidase__InfluenzaA__AGW00832

SEQ ID NO: 84898 - RNA, 1410 nt, Artificial Sequence
  derived and/or modified sequence opt1 from neuraminidase__InfluenzaA__AGW00844
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 84899 - RNA, 1410 nt, Artificial Sequence; identical to SEQ ID NO: 84891
  derived and/or modified sequence opt1 from neuraminidase__InfluenzaA__AGW00868

SEQ ID NO: 84900 - RNA, 1410 nt, Artificial Sequence
  derived and/or modified sequence opt1 from neuraminidase__InfluenzaA__AGW00880
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacgucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggaagcucguggacuccgucgugagcugguccaaggagauccugcggacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgcuacccggacgugcggugcgugugccgcgacaacuggaagggcagcaaccggcccaucgucgacaucaacaucaaggaccacuccaucgugagccgcuacgugugcuccgggcuggucggcgacacgccccggaagaacgacagcuccagcuccagccacugccuggaccccaacaacgaggagggcgggcacggcgugaaggggugggccuucgacgacggcaacgacgucuggauggggcgcaccaucaacgagaccucccggcucggcuacgagaccuucaaggugaucgagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcgggcggaaggaggagaccgagguccucuggaccagcaacagcaucgugguguucugcggcacguccggcaccuacgggaccggcagcuggcccgacggggccgaccugaaccugaugcccaucuga

SEQ ID NO: 84901 - RNA, 1410 nt, Artificial Sequence
  derived and/or modified sequence opt1 from neuraminidase__InfluenzaA__AGW00892
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccgcgguaccccgggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaugaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 84902 - RNA, 1410 nt, Artificial Sequence
  derived and/or modified sequence opt1 from neuraminidase__InfluenzaA__AGW00904
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgggccggacaagugcuaccaguucgcccugggccagggcaccacgcucaacaacaugcacuccaacaacaccgugcgcgaccggacccccuaccgcacccugcugaugaacgagcucgggguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaugaccgacggcuccgccagcgggaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaagggcagcaaccgccccaucguggacaucaacaucaaggaccacuccaucgugagcuccuacgucugcagcgggcuggugggcgacaccccgcggaagaacgacuccagcuccagcucccacugccuggaccccaacaacgaggagggcgggcacggggugaagggcugggccuucgacgacggcaacgacgucuggauggggcgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 84903 - RNA, 1410 nt, Artificial Sequence
  derived and/or modified sequence opt1 from neuraminidase__InfluenzaA__AGW00916
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugugcgaccgcacccccuaccggacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccgccucguggacuccguggugagcugguccaaggagauccugcggacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgcuacccgggggugcggugcgucugccgcgacaacuggaagggcagcaaccggcccaucguggacaucaacaucaaggaccacuccaucgugagcuccuacgucugcagcggccuggugggggacaccccgcgcaagaacgacuccagcuccagcucccacugccuggaccccaacaacgaggagggcgggcacggcgugaaggggugggccuucgacgacggcaacgacgucuggaugggccggaccaucaacgagacgagccgccucggguacgagaccuucaaggugaucgagggcugguccaaccccaagagcaagcugcagaucaaccggcaggucaucguggaccgcggggaccgguccggcuacagcgggaucuucuccguggagggcaagagcugcaucaaccgcugcuucuacgucgagcugauccggggccgcaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84904 - RNA, 1410 nt, Artificial Sequence; identical to SEQ ID NO: 84879
  derived and/or modified sequence opt1 from neuraminidase__InfluenzaA__AGW00934

SEQ ID NO: 84905 - RNA, 1410 nt, Artificial Sequence
  derived and/or modified sequence opt1 from neuraminidase__InfluenzaA__AGW01247
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaaggacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84906 - RNA, 1410 nt, Artificial Sequence; identical to SEQ ID NO: 83154
  derived and/or modified sequence opt1 from neuraminidase__InfluenzaA__AGW01259

SEQ ID NO: 84907 - RNA, 1410 nt, Artificial Sequence; identical to SEQ ID NO: 84891
  derived and/or modified sequence opt1 from neuraminidase__InfluenzaA__AGW01298

SEQ ID NO: 84908 - RNA, 1410 nt, Artificial Sequence; identical to SEQ ID NO: 84383
  derived and/or modified sequence opt1 from neuraminidase__InfluenzaA__AGW01322

SEQ ID NO: 84909 - RNA, 1410 nt, Artificial Sequence
  derived and/or modified sequence opt1 from neuraminidase__InfluenzaA__AGW01334
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggaggccgaggugcucuggaccagcaacuccaucgucguguucugcgggaccagcggcacguacgggaccggcuccuggcccgacggggccgaccugaaccugaugcccaucuga

SEQ ID NO: 84910 - RNA, 1410 nt, Artificial Sequence; identical to SEQ ID NO: 83154
  derived and/or modified sequence opt1 from neuraminidase__InfluenzaA__AGW01346

SEQ ID NO: 84911 - RNA, 1410 nt, Artificial Sequence
  derived and/or modified sequence opt1 from neuraminidase__InfluenzaA__AGW01358
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccgaccgaguaccggaacuggagcaagccccagugcgggaucaccggcuucgcccccuucuccaaggacaacagcauccgccuguccgccgggggcgacaucugggucacccgggagcccuacgugagcugcgacccggacaagugcuaccaguucgcgcuggggcagggcacgacccucaacaacgugcacuccaacaacaccguccgcgaccggacccccuaccgcacgcugcugaugaacgagcucggcgugcccuuccaccuggggaccaagcaggucugcaucgccuggagcuccagcuccugccacgacggcaaggccuggcugcacgugugcaucaccggggacgacaagaacgccaccgcgagcuucaucuacaacggccggcucguggacuccguggucagcugguccaaggagauccugcgcacgcaggagagcgagugcgugugcaucaacgggaccugcaccguggucaugaccgacggcuccgccagcggcaaggccgacacgaagauccuguucaucgaggaggggaagaucgugcacaccagcacccucuccggcagcgcccagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggcguucgacgacggcaacgacguguggaugggccgcacgaucaacgagaccagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggacgagcaacuccaucgucguguucugcgggaccagcggcaccuacgggaccggcuccuggcccgacggggccgaccugaaccugaugcccaucuga

SEQ ID NO: 84912 - RNA, 1410 nt, Artificial Sequence; identical to SEQ ID NO: 83154
  derived and/or modified sequence opt1 from neuraminidase__InfluenzaA__AGW01370

SEQ ID NO: 84913 - RNA, 1410 nt, Artificial Sequence; identical to SEQ ID NO: 83154
  derived and/or modified sequence opt1 from neuraminidase__InfluenzaA__AGW01382

SEQ ID NO: 84914 - RNA, 1410 nt, Artificial Sequence
  derived and/or modified sequence opt1 from neuraminidase__InfluenzaA__AGW01394
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccaucgugagcugguccaaggacauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84915 - RNA, 1410 nt, Artificial Sequence
  derived and/or modified sequence opt1 from neuraminidase__InfluenzaA__AGW01406
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacaugcacuccaacaacaccgugcgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggugagcugguccaaggagauccugcgcacccaggagagcgagugcgucugcaucaacggcacgugcaccguggugaucaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagcuccuacgucugcagcggccuggugggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggucaucguggaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 84916 - RNA, 1410 nt, Artificial Sequence
  derived and/or modified sequence opt1 from neuraminidase__InfluenzaA__AGW01418
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccggggugcucuggaccagcaacuccaucguggucuucugcggcacgagcgggaccuacggcaccggguccuggcccgacggcgccgaccugaaccugaugcccaucuga

SEQ ID NO: 84917 - RNA, 1410 nt, Artificial Sequence; identical to SEQ ID NO: 83154
  derived and/or modified sequence opt1 from neuraminidase__InfluenzaA__AGW01430

SEQ ID NO: 84918 - RNA, 1410 nt, Artificial Sequence; identical to SEQ ID NO: 83154
  derived and/or modified sequence opt1 from neuraminidase__InfluenzaA__AGW01442

SEQ ID NO: 84919 - RNA, 1410 nt, Artificial Sequence; identical to SEQ ID NO: 83154
  derived and/or modified sequence opt1 from neuraminidase__InfluenzaA__AGW01454

SEQ ID NO: 84920 - RNA, 1410 nt, Artificial Sequence; identical to SEQ ID NO: 84879
  derived and/or modified sequence opt1 from neuraminidase__InfluenzaA__AGW01466

SEQ ID NO: 84921 - RNA, 1410 nt, Artificial Sequence; identical to SEQ ID NO: 83154
  derived and/or modified sequence opt1 from neuraminidase__InfluenzaA__AGW01478

SEQ ID NO: 84922 - RNA, 1410 nt, Artificial Sequence
  derived and/or modified sequence opt1 from neuraminidase__InfluenzaA__AGW01490
augaaccccaaccagaagaucaucaccaucagcuccgugagccugaccaucuccacgaucugcuucuucaugcagaucgccauccucaucaccaccgucacccugcacuucaagcaguacgaguucaacagcccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcggcaucaccggguucgcgcccuucagcaaggacaacuccauccgccugagcgccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgguacccgggcguccgcugcgugugccgggacaacuggaagggguccaaccgccccaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaacuccaagagcaagcugcagaucaaccgccaggugaucguggaccggggcgaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcacgagcgggaccuacggcaccggguccuggccggacggcgccgaccugaaccugaugcccaucuga

SEQ ID NO: 84923 - RNA, 1410 nt, Artificial Sequence; identical to SEQ ID NO: 83154
  derived and/or modified sequence opt1 from neuraminidase__InfluenzaA__AGW01538

SEQ ID NO: 84924 - RNA, 1410 nt, Artificial Sequence; identical to SEQ ID NO: 84879
  derived and/or modified sequence opt1 from neuraminidase__InfluenzaA__AGW01562

SEQ ID NO: 84925 - RNA, 1410 nt, Artificial Sequence; identical to SEQ ID NO: 83154
  derived and/or modified sequence opt1 from neuraminidase__InfluenzaA__AGW01574

SEQ ID NO: 84926 - RNA, 1410 nt, Artificial Sequence; identical to SEQ ID NO: 83154
  derived and/or modified sequence opt1 from neuraminidase__InfluenzaA__AGW01586

SEQ ID NO: 84927 - RNA, 1410 nt, Artificial Sequence; identical to SEQ ID NO: 83154
  derived and/or modified sequence opt1 from neuraminidase__InfluenzaA__AGW01598

SEQ ID NO: 84928 - RNA, 1410 nt, Artificial Sequence; identical to SEQ ID NO: 84879
  derived and/or modified sequence opt1 from neuraminidase__InfluenzaA__AGW01610

SEQ ID NO: 84929 - RNA, 1410 nt, Artificial Sequence; identical to SEQ ID NO: 83154
  derived and/or modified sequence opt1 from neuraminidase__InfluenzaA__AGW01622

SEQ ID NO: 84930 - RNA, 1410 nt, Artificial Sequence; identical to SEQ ID NO: 83154
  derived and/or modified sequence opt1 from neuraminidase__InfluenzaA__AGW01634

SEQ ID NO: 84931 - RNA, 1410 nt, Artificial Sequence
  derived and/or modified sequence opt1 from neuraminidase__InfluenzaA__AGW01646
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucgacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84932 - RNA, 1410 nt, Artificial Sequence; identical to SEQ ID NO: 83154
  derived and/or modified sequence opt1 from neuraminidase__InfluenzaA__AGW01670

SEQ ID NO: 84933 - RNA, 1410 nt, Artificial Sequence; identical to SEQ ID NO: 83154
  derived and/or modified sequence opt1 from neuraminidase__InfluenzaA__AGW01682

SEQ ID NO: 84934 - RNA, 1410 nt, Artificial Sequence; identical to SEQ ID NO: 84891
  derived and/or modified sequence opt1 from neuraminidase__InfluenzaA__AGW01704

SEQ ID NO: 84935 - RNA, 1410 nt, Artificial Sequence
  derived and/or modified sequence opt1 from neuraminidase__InfluenzaA__AGW01716
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggccggagcugcaucaaccgcugcuucuacgucgagcugauccggggccgcaaggaggagaccgaggugcucuggaccagcaacuccaucguggucuucugcgggacgagcggcaccuacgggaccggcuccuggcccgacggggccgaccugaaccugaugcccaucuga

SEQ ID NO: 84936 - RNA, 1410 nt, Artificial Sequence
  derived and/or modified sequence opt1 from neuraminidase__InfluenzaA__AGW01728
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccguggucguguucugcgggacgagcggcaccuacgggaccggcuccuggcccgacggggccgaccugaaccugaugcccaucuga

SEQ ID NO: 84937 - RNA, 1410 nt, Artificial Sequence; identical to SEQ ID NO: 83154
  derived and/or modified sequence opt1 from neuraminidase__InfluenzaA__AGW01740

SEQ ID NO: 84938 - RNA, 1410 nt, Artificial Sequence
  derived and/or modified sequence opt1 from neuraminidase__InfluenzaA__AGW01752
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucggcgggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 84939 - RNA, 1410 nt, Artificial Sequence; identical to SEQ ID NO: 83154
  derived and/or modified sequence opt1 from neuraminidase__InfluenzaA__AGW01764

SEQ ID NO: 84940 - RNA, 1410 nt, Artificial Sequence; identical to SEQ ID NO: 84891
  derived and/or modified sequence opt1 from neuraminidase__InfluenzaA__AGW01776

SEQ ID NO: 84941 - RNA, 1410 nt, Artificial Sequence; identical to SEQ ID NO: 84879
  derived and/or modified sequence opt1 from neuraminidase__InfluenzaA__AGW01788

SEQ ID NO: 84942 - RNA, 1410 nt, Artificial Sequence; identical to SEQ ID NO: 84891
  derived and/or modified sequence opt1 from neuraminidase__InfluenzaA__AGW01800

SEQ ID NO: 84943 - RNA, 1410 nt, Artificial Sequence; identical to SEQ ID NO: 84879
  derived and/or modified sequence opt1 from neuraminidase__InfluenzaA__AGW01812

SEQ ID NO: 84944 - RNA, 1410 nt, Artificial Sequence; identical to SEQ ID NO: 84879
  derived and/or modified sequence opt1 from neuraminidase__InfluenzaA__AGW01824

SEQ ID NO: 84945 - RNA, 1410 nt, Artificial Sequence; identical to SEQ ID NO: 84902
  derived and/or modified sequence opt1 from neuraminidase__InfluenzaA__AGW01848

SEQ ID NO: 84946 - RNA, 1410 nt, Artificial Sequence
  derived and/or modified sequence opt1 from neuraminidase__InfluenzaA__AGW01860
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugcuucgaccccaacaacgaggagggcgggcacggcgucaaggggugggccuucgacgacggcaacgacguguggaugggccgcaccaucaacgagaccagccggcucggguacgagaccuucaaggucaucggcgggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucaucgucuucugcggcacgagcgggaccuacggcaccggguccuggccggacggcgccgaccugaaccugaugcccaucuga

SEQ ID NO: 84947 - RNA, 1410 nt, Artificial Sequence
  derived and/or modified sequence opt1 from neuraminidase__InfluenzaA__AGW01884
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 84948 - RNA, 1410 nt, Artificial Sequence; identical to SEQ ID NO: 83154
  derived and/or modified sequence opt1 from neuraminidase__InfluenzaA__AGW01896

SEQ ID NO: 84949 - RNA, 1410 nt, Artificial Sequence; identical to SEQ ID NO: 83154
  derived and/or modified sequence opt1 from neuraminidase__InfluenzaA__AGW01908

SEQ ID NO: 84950 - RNA, 1410 nt, Artificial Sequence; identical to SEQ ID NO: 83154
  derived and/or modified sequence opt1 from neuraminidase__InfluenzaA__AGW01920

SEQ ID NO: 84951 - RNA, 1410 nt, Artificial Sequence; identical to SEQ ID NO: 83154
  derived and/or modified sequence opt1 from neuraminidase__InfluenzaA__AGW01932

SEQ ID NO: 84952 - RNA, 1410 nt, Artificial Sequence
  derived and/or modified sequence opt1 from neuraminidase__InfluenzaA__AGW01944
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggcccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 84953 - RNA, 1410 nt, Artificial Sequence; identical to SEQ ID NO: 83154
  derived and/or modified sequence opt1 from neuraminidase__InfluenzaA__AGW01956

SEQ ID NO: 84954 - RNA, 1410 nt, Artificial Sequence
  derived and/or modified sequence opt1 from neuraminidase__InfluenzaA__AGW01968
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccauccgcgaccggacccccuaccgcacccugcugaugaacgagcucggcguccccuuccaccugggcacgaagcaggucugcaucgccuggagcuccagcuccugccacgacgggaaggccuggcugcacgugugcaucaccggcgacgacgagaacgcgaccgccagcuucaucuacaacgggcggcucguggacuccguggugagcugguccaaggagauccugcgcacccaggagagcgagugcgucugcaucaacggcacgugcaccguggugaugaccgacggguccgccagcggcaaggccgacaccaagauccuguucaucgaggagggcaagaucguccacacgagcacccucuccgggagcgcgcagcacguggaggagugcuccugcuacccccgguacccgggcgugcgcugcgucugccgggacaacuggaaggggagcaaccgccccaucguggacaucaacaucaaggaccacuccaucgugagccgguacgucugcuccggccuggugggcgacacgccccgcaagaacgacagcuccagcuccagccacugccuggaccccaacaacgaggagggcgggcacggggugaagggcugggccuucgacgacgggaacgacgucuggaugggccggaccaucaacgagaccucccgccucggcuacgagaccuucaaggugaucgagggguggagcaacccgaaguccaagcugcagaucaaccggcaggucaucguggaccgcggcgaccggagcggguacuccggcaucuucagcguggaggggaaguccugcaucaaccgcugcuucuacgucgagcugauccggggccgcaaggaggagaccgaggugcucuggaccagcaacagcaucguggucuucugcggcacguccgggaccuacggcaccgggagcuggcccgacggcgccgaccugaaccugaugcccaucuga

SEQ ID NO: 84955 - RNA, 1410 nt, Artificial Sequence; identical to SEQ ID NO: 84879
  derived and/or modified sequence opt1 from neuraminidase__InfluenzaA__AGW01980

SEQ ID NO: 84956 - RNA, 1410 nt, Artificial Sequence; identical to SEQ ID NO: 83154
  derived and/or modified sequence opt1 from neuraminidase__InfluenzaA__AGW01992

SEQ ID NO: 84957 - RNA, 1410 nt, Artificial Sequence; identical to SEQ ID NO: 83154
  derived and/or modified sequence opt1 from neuraminidase__InfluenzaA__AGW02004

SEQ ID NO: 84958 - RNA, 1410 nt, Artificial Sequence; identical to SEQ ID NO: 83154
  derived and/or modified sequence opt1 from neuraminidase__InfluenzaA__AGW02016

SEQ ID NO: 84959 - RNA, 1410 nt, Artificial Sequence; identical to SEQ ID NO: 83154
  derived and/or modified sequence opt1 from neuraminidase__InfluenzaA__AGW02040

SEQ ID NO: 84960 - RNA, 1410 nt, Artificial Sequence
  derived and/or modified sequence opt1 from neuraminidase__InfluenzaA__AGW02064
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcggccacugccuggaccccaacaacgaggagggcgggcacggggucaagggcugggccuucgacgacggcaacgacguguggauggggcgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaaguccugcaucaaccggugcuucuacguggagcugauccgcgggcggaaggaggagaccgaggugcucuggaccagcaacagcaucgucguguucugcggcacguccgggaccuacggcaccgggagcuggcccgacggcgccgaccugaaccugaugcccaucuga

SEQ ID NO: 84961 - RNA, 1410 nt, Artificial Sequence; identical to SEQ ID NO: 83154
  derived and/or modified sequence opt1 from neuraminidase__InfluenzaA__AGW02076

SEQ ID NO: 84962 - RNA, 1410 nt, Artificial Sequence; identical to SEQ ID NO: 83154
  derived and/or modified sequence opt1 from neuraminidase__InfluenzaA__AGW02088

SEQ ID NO: 84963 - RNA, 1410 nt, Artificial Sequence
  derived and/or modified sequence opt1 from neuraminidase__InfluenzaA__AGW02100
augaaccccaaccagaagaucaucaccaucggcagcgugucccugaccaucagcacgaucugcuucuucaugcagaucgccauccucaucaccaccgucacccugcacuucaagcaguacgaguccaacagcccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggacguccggcaccuacgggaccggcagcuggcccgacggggccgaccugaaccugaugcccaucuga

SEQ ID NO: 84964 - RNA, 1410 nt, Artificial Sequence; identical to SEQ ID NO: 84891
  derived and/or modified sequence opt1 from neuraminidase__InfluenzaA__AGW02112

SEQ ID NO: 84965 - RNA, 1410 nt, Artificial Sequence
  derived and/or modified sequence opt1 from neuraminidase__InfluenzaA__AGW02124
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccgucagcgaccgcacccccuaccggacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccgccucguggacagcguggucuccuggagcaaggagauccugcggacccaggaguccgagugcgugugcaucaacgggacgugcaccguggucaugaccgacggcagcgccagcggcaaggccgacaccaagauccuguucaucgaggaggggaagaucgugcacacguccacccucagcggcuccgcgcagcacguggaggagugcagcugcuacccccgcuacccggggguccggugcgugugccgcgacaacuggaagggcuccaaccggcccaucguggacaucaacaucaaggaccacagcaucgucuccagcuacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaagagcugcaucaaccgcugcuucuacguggagcugauccggggccgcaaggaggagaccgaggugcucuggaccuccaacagcaucgucguguucugcgggacguccggcaccuacgggaccggcagcuggcccgacggggccgaccugaaccugaugcccaucuga

SEQ ID NO: 84966 - RNA, 1410 nt, Artificial Sequence; identical to SEQ ID NO: 84879
  derived and/or modified sequence opt1 from neuraminidase__InfluenzaA__AGW02136

SEQ ID NO: 84967 - RNA, 1410 nt, Artificial Sequence; identical to SEQ ID NO: 84891
  derived and/or modified sequence opt1 from neuraminidase__InfluenzaA__AGW02148

SEQ ID NO: 84968 - RNA, 1410 nt, Artificial Sequence
  derived and/or modified sequence opt1 from neuraminidase__InfluenzaA__AGW02160
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgguccgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgccgaccugaaccugaugcccaucuga

SEQ ID NO: 84969 - RNA, 1410 nt, Artificial Sequence; identical to SEQ ID NO: 83154
  derived and/or modified sequence opt1 from neuraminidase__InfluenzaA__AGW02172

SEQ ID NO: 84970 - RNA, 1410 nt, Artificial Sequence; identical to SEQ ID NO: 83154
  derived and/or modified sequence opt1 from neuraminidase__InfluenzaA__AGW02184

SEQ ID NO: 84971 - RNA, 1410 nt, Artificial Sequence
  derived and/or modified sequence opt1 from neuraminidase__InfluenzaA__AGW02196
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgacccguacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgacaccaagauccuguucaucgaggaggggaagaucgugcacaccagcacgcucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 84972 - RNA, 1410 nt, Artificial Sequence; identical to SEQ ID NO: 84383
  derived and/or modified sequence opt1 from neuraminidase__InfluenzaA__AGW04174

SEQ ID NO: 84973 - RNA, 1410 nt, Artificial Sequence
  derived and/or modified sequence opt1 from neuraminidase__InfluenzaA__AGW25784
augaaccccaaccagaagaucaucaccaucggcagcgugucccugaucaucgccaccaucugcuuccucaugcagaucgccauccuggucacgaccgugacccugcacuucaagcaguacggguacaacagccucccgaacaaccaggugaugcugugcgagcccaccaucaucgagcgcaacaucacggagaucgucuaccugaccaacaccaccaucgagaaggagaucugccccaagcucgcggaguaccggaacugguccaagccccagugcaagaucacgggcuucgccccguucagcaaggacaacuccauccgccugagcgccgggggcgacaucugggugacccgggagcccuacguguccugcgaccccuacaagugcuaccaguucgcccuggggcagggcaccacccucaacaacaagcacagcaacgacacgguccacgaccgcacccccuaccggacccugcugaugaacgagcucggcgugccguuccaccuggggaccaagcaggucugcaucgccugguccagcuccagcugccacgacggcaaggcguggcugcacaucugcgugacggggcacgacgagaacgccaccgccuccuucaucuacgacggcaagcucguggacagcaucggguccuggagcaagaagauccugcgcacccaggaguccgagugcgugugcaucaacgggaccugcacggucgugaugaccgacggcagcgccuccgggcgggcggacaccaagauccuguucaucgaggagggcaagaucauccacaucagccagcucagcggguccgcccagcacguggaggagugcagcugcuacccccgcuaccccggcauccggugcgucugccgcgacaacuggaagggcuccaaccggcccaucguggacaucaacgugaaggacuacagcaucaccuccagcuacgucugcuccgggcuggugggcgacacgccgcgcaagaccgacaacagcuccagcucccacugccugaaccccaacaacgaggagggcggccacggggugaagggcugggccuucgacgacggcaacgacgucuggauggggcggaccaucagcgagaaguuccgcuccggcuacgagaccuucaaggugaucaagggguggagcaagcccaacuccaagcuccagaucaaccgccaggugaucgucgaccgggacaaccggagcggcuacuccgggaucuucagcguggagggcaaguccugcaucaaccgcugcuucuacgucgagcugauccggggccgcaagcgggaggccgaggugugguggacgagcaacagcaucguggucuucugcgggaccuccggcaccuacgggaccggcagcuggcccgacggggccgacaucaaccugaugccgaucuga

SEQ ID NO: 84974 - RNA, 1350 nt, Artificial Sequence
  derived and/or modified sequence opt1 from neuraminidase__InfluenzaA__AGW27062
augaaccccaaccagaagaucgugaccaucggcagcaucugcauggucaucgggaccaucucccugaugcuccagaucggcaacaucaucagcaucugggugucccacagcauccagacggggaaccagcaccagaccgagccgauccgcaacaccaacuuccugaccgagaacgccguggccuccgucacgcuggcgggcaacagcucccucugccccauccgggggugggccgugcacagcaaggacaacuccauccgcaucggcagcaagggcgacguguucgucauccgggagcccuucaucuccugcagccaccuggagugccgcaccuucuuccugacccagggggcccuccugaacgacaagcacuccaacggcaccgugaaggaccggagcccccaccgcacgcugauguccugcccgaucggggaggcccccagccccuacaacucccgguucgagagcguggccugguccgcgagcgccugccacgacggcaccagcuggcucgucaucgggaucuccggccccgacaacggcgccguggccgugcugaaguacaacgggaucaucaccgacaccauccgcagcuggcggaacaacauccugcgcacgcaggaguccgagugcgcgugcgucaacggcagcugcuucaccgugaugaccgacgggccguccaacggccaggccagcuacaagaucuucaagaucgagaagggcaagguggucaaguccguggagcucaacgcccccaacuaccacuacgaggagugcagcugcuaccccgacgccggggagaucacgugcgugugccgggacaacuggcacggcuccaaccgccccugggucagcuucaaccagaaccuggaguaccagaucggguacaucugcuccggcguguucggggacaacccgcggcccaacgacggcaccggcagcugcgggcccguguccagcaacggcgccuacggggucaagggcuucuccuucaaguacgggaacggcguguggaucggccgcaccaagagcacccacucccggagcggguucgagaugaucugggaccccaacggcuggaccgggacggacuccgaguucagcaugaagcaggacaucguggcgaucaccgacuggagcggcuacuccgggagcuucguccagcacccggagcugaccggccucgacugcauccgccccugcuucuggguggagcugauccggggccgccccaaggaguccaccaucuggacgagcggguccagcaucuccuucugcggcgucaacagcgacaccguguccuggagcuggcccgacggggccgagcugccguucaccaucgacaaguga

SEQ ID NO: 84975 - RNA, 1410 nt, Artificial Sequence
  derived and/or modified sequence opt1 from neuraminidase__InfluenzaA__AGY14472
augaaccccaaccagaagaucaucaccaucggcagcgugucccugacccucgccacgaucugcuuccugaugcagaucgccauccuggucaccaccgugacccuccacuucaagcaguacgagugcaacagcacgccgaacaaccaggugaugcugugcgagcccaccgucaucgagcgcaacaucaccaagaucguguaccugaccaacacgaccguggagaaggagaucugccccaagcccgcggaguaccggaacugguccaagccgcagugcaagaucaccggguucgcccccuucagcaaggacaacuccauccgccucagcgccggcggggacaucugggucacccgggagcccuacguguccugcgaccccaacaagugcuaccaguucgcccugggccaggggacgacccugaacaaccgccacagcaacgacaccgugcacgaccggaccccguaccgcacgcuccugaugaacgagcugggcauccccuuccaccucggcaccaagcaggucugcaucgccugguccagcuccagcugccacgacgggaaggcguggcugcacgugugcgugaccggccacgacaagaacgccaccgccuccuucaucuacgacgggaagcuggucgacagcaucggcuccuggagcaagaagauccuccggacgcaggaguccgagugcgugugcaucaacgggaccugcaccguggucaugaccgacggcagcgccuccggccgcgcggacacgaagauccuguucaucgaggaggggaagaucauccacaucagccagcugagcggcuccgcccagcacguggaggagugcagcugcuacccccgguaccccgggauccgcugcgugugccgggacaacuggaagggcuccaaccgcccgaucgucgacaucaacgugaaggacuacagcaucaccuccagcuacgugugcuccggccucgucggggacacgccccggaagaccgacaacagcuccagcucccacugccugaaccccaacaacgaggagggcgggcacggcgugaaggggugggccuucgacgacggcaacgacguguggaugggccgcaccaucagcgagaaguuccgguccggguacgagaccuucaaggucaucaagggcuggagcaagcccaacuccaagcugcagaucaaccgccaggugaucgucgaccgggacaaccgcagcggguacuccggcaucuucagcguggaggggaaguccugcaucaaccggugcuucuacguggagcucauccgcggccggaagcgcgaggccgaggucugguggaccagcaacagcaucgugguguucugcggcaccuccgggacguacggcaccgggagcuggccggacggcgccgacaucaaccugaugcccaucuga

SEQ ID NO: 84976 - RNA, 1398 nt, Artificial Sequence
  derived and/or modified sequence opt1 from neuraminidase__InfluenzaA__AHA11501
augaaccccaaccagaagauccugugcaccagcgccaccgccaucaucaucggcgcgaucgccgugcucaucgggaucgccaaccugggccugaacaucgggcuccaccugaagccgggcugcaacugcucccacagccagcccgagacgaccaacaccucccagaccaucaucaacaacuacuacaacgagacgaacaucaccaacauccagauggaggagcgcaccagccggaacuucaacaaccugaccaaggggcucugcacgaucaacuccuggcacaucuacggcaaggacaacgccguccgcaucggcgagagcuccgacgugcuggugacccgggagcccuacgucagcugcgaccccgacgagugccgcuucuacgcccugucccaggggaccaccauccggggcaagcacagcaacgggacgauccacgaccgcucccaguaccgggcgcucaucagcuggccgcuguccagcccgcccaccguguacaacucccgcguggagugcaucggcuggagcuccaccagcugccacgacgggaagucccggaugagcaucugcaucagcggccccaacaacaacgccuccgccgucgugugguacaaccgccggcccguggccgagaucaacaccugggcgcgcaacauccugcggacgcaggagagcgagugcgucugccacaacggcgugugccccaucguguucaccgacggguccgccaccggccccgccgacacccgcaucuacuacuucaaggaggggaagauccucgagugggagagccugacgggcaccgccaagcacaucgaggagugcuccugcuacggcgagcggaccgggaucacgugcacgugccgcgacaacuggcagggcagcaaccggcccgucauccagaucgacccgguggccaugacccacaccucccaguacaucugcagccccgugcugaccgacacgccccgccccaacgacccgaacaucgggaagugcaacgaccccuaccccggcaacgacaacaacggggucaagggcuucuccuaccucgacggcgcgaacaccuggcuggggcggaccaucagcaccgccucccgcagcggcuacgagaugcugaaggugcccaacgcccucaccgacgaccgguccaagccgauccaggggcagaccaucgugcugaacgccgacuggagcggcuacuccgggagcuucauggacuacugggccgagggcgacugcuaccgcgcgugcuucuacgucgagcugauccgcggccggcccaaggaggacaaggugugguggaccuccaacagcaucguguccaugugcagcagcaccgaguuccucgggcaguggaacuggcccgacggcgcccgcaucgaguacuuccuguga

SEQ ID NO: 84977 - RNA, 1410 nt, Artificial Sequence
  derived and/or modified sequence opt1 from neuraminidase__InfluenzaA__AHC57462
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugcugggaccccaacaacgaggagggcgggcacggggucaagggcugggccuucgacgacgggaacgacguguggaugggccgcaccaucaacgagaccagccggcucggcuacgagaccuucaaggucaucgaggggugguccaaccccaagagcaagcuccaggugaaccgccaggugaucgucgaccggggcgaccgcuccggguacagcggcaucuucuccguggagggcaagagcugcaucaaccggugcuucuacguggagcugauccgcgggcggaaggaggagaccgagguccuguggaccagcaacuccaucgugguguucugcggcacgagcgggaccuacggcaccggguccuggccggacggcgccgaccugaaccugaugcccaucuga

SEQ ID NO: 84978 - RNA, 1410 nt, Artificial Sequence; identical to SEQ ID NO: 80526
  derived and/or modified sequence opt1 from neuraminidase__InfluenzaA__AHC57490

SEQ ID NO: 84979 - RNA, 1410 nt, Artificial Sequence
  derived and/or modified sequence opt1 from neuraminidase__InfluenzaA__AHC57514
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 84980 - RNA, 1410 nt, Artificial Sequence; identical to SEQ ID NO: 84979
  derived and/or modified sequence opt1 from neuraminidase__InfluenzaA__AHC57526

SEQ ID NO: 84981 - RNA, 1410 nt, Artificial Sequence; identical to SEQ ID NO: 84979
  derived and/or modified sequence opt1 from neuraminidase__InfluenzaA__AHC57806

SEQ ID NO: 84982 - RNA, 1410 nt, Artificial Sequence; identical to SEQ ID NO: 84979
  derived and/or modified sequence opt1 from neuraminidase__InfluenzaA__AHC57818

SEQ ID NO: 84983 - RNA, 1410 nt, Artificial Sequence
  derived and/or modified sequence opt1 from neuraminidase__InfluenzaA__AHC57830
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 84984 - RNA, 1410 nt, Artificial Sequence; identical to SEQ ID NO: 84983
  derived and/or modified sequence opt1 from neuraminidase__InfluenzaA__AHC57971

SEQ ID NO: 84985 - RNA, 1410 nt, Artificial Sequence; identical to SEQ ID NO: 84979
  derived and/or modified sequence opt1 from neuraminidase__InfluenzaA__AHC57984

SEQ ID NO: 84986 - RNA, 1410 nt, Artificial Sequence
  derived and/or modified sequence opt1 from neuraminidase__InfluenzaA__AHC57996
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccgcaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 84987 - RNA, 1410 nt, Artificial Sequence; identical to SEQ ID NO: 83930
  derived and/or modified sequence opt1 from neuraminidase__InfluenzaA__AHC58008

SEQ ID NO: 84988 - RNA, 1410 nt, Artificial Sequence; identical to SEQ ID NO: 80526
  derived and/or modified sequence opt1 from neuraminidase__InfluenzaA__AHC58020

SEQ ID NO: 84989 - RNA, 1410 nt, Artificial Sequence
  derived and/or modified sequence opt1 from neuraminidase__InfluenzaA__AHC58032
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucaaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 84990 - RNA, 1410 nt, Artificial Sequence; identical to SEQ ID NO: 83930
  derived and/or modified sequence opt1 from neuraminidase__InfluenzaA__AHC58053

SEQ ID NO: 84991 - RNA, 1410 nt, Artificial Sequence
  derived and/or modified sequence opt1 from neuraminidase__InfluenzaA__AHC58077
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugcgcgagcccacgaucaucgagcggaacaucaccgagaucguguaccucaccaacaccacgaccgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccgacaagugcuaccaguucgcccucggccaggggacgacccugaacaacgugcacuccaacaacaccguccgggaccgcaccccguaccggacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgaccugaaccucaugcccaucuga

SEQ ID NO: 84992 - RNA, 1410 nt, Artificial Sequence; identical to SEQ ID NO: 84983
  derived and/or modified sequence opt1 from neuraminidase__InfluenzaA__AHC58089

SEQ ID NO: 84993 - RNA, 1410 nt, Artificial Sequence; identical to SEQ ID NO: 84979
  derived and/or modified sequence opt1 from neuraminidase__InfluenzaA__AHC58101

SEQ ID NO: 84994 - RNA, 1410 nt, Artificial Sequence
  derived and/or modified sequence opt1 from neuraminidase__InfluenzaA__AHC58113
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaagaagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 84995 - RNA, 1410 nt, Artificial Sequence; identical to SEQ ID NO: 84979
  derived and/or modified sequence opt1 from neuraminidase__InfluenzaA__AHC58129

SEQ ID NO: 84996 - RNA, 1410 nt, Artificial Sequence; identical to SEQ ID NO: 84979
  derived and/or modified sequence opt1 from neuraminidase__InfluenzaA__AHC58153

SEQ ID NO: 84997 - RNA, 1410 nt, Artificial Sequence; identical to SEQ ID NO: 84979
  derived and/or modified sequence opt1 from neuraminidase__InfluenzaA__AHC58165

SEQ ID NO: 84998 - RNA, 1410 nt, Artificial Sequence; identical to SEQ ID NO: 84983
  derived and/or modified sequence opt1 from neuraminidase__InfluenzaA__AHC58177

SEQ ID NO: 84999 - RNA, 1410 nt, Artificial Sequence
  derived and/or modified sequence opt1 from neuraminidase__InfluenzaA__AHC58189
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagaugagccggcucggcuacgagacguucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcaccagcgggacguacggcaccggguccuggcccgacggcgccgaccugaaccugaugcccaucuga

SEQ ID NO: 85000 - RNA, 1410 nt, Artificial Sequence; identical to SEQ ID NO: 84979
  derived and/or modified sequence opt1 from neuraminidase__InfluenzaA__AHC58201

SEQ ID NO: 85001 - RNA, 1410 nt, Artificial Sequence
  derived and/or modified sequence opt1 from neuraminidase__InfluenzaA__AHC58225
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgugaaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85002 - RNA, 1410 nt, Artificial Sequence; identical to SEQ ID NO: 84983
  derived and/or modified sequence opt1 from neuraminidase__InfluenzaA__AHC58237

SEQ ID NO: 85003 - RNA, 1410 nt, Artificial Sequence; identical to SEQ ID NO: 84979
  derived and/or modified sequence opt1 from neuraminidase__InfluenzaA__AHC58249

SEQ ID NO: 85004 - RNA, 1410 nt, Artificial Sequence; identical to SEQ ID NO: 80526
  derived and/or modified sequence opt1 from neuraminidase__InfluenzaA__AHC58273

SEQ ID NO: 85005 - RNA, 1410 nt, Artificial Sequence; identical to SEQ ID NO: 84983
  derived and/or modified sequence opt1 from neuraminidase__InfluenzaA__AHC58363

SEQ ID NO: 85006 - RNA, 1410 nt, Artificial Sequence; identical to SEQ ID NO: 83930
  derived and/or modified sequence opt1 from neuraminidase__InfluenzaA__AHC58375

SEQ ID NO: 85007 - RNA, 1410 nt, Artificial Sequence; identical to SEQ ID NO: 84983
  derived and/or modified sequence opt1 from neuraminidase__InfluenzaA__AHC58387

SEQ ID NO: 85008 - RNA, 1410 nt, Artificial Sequence; identical to SEQ ID NO: 84983
  derived and/or modified sequence opt1 from neuraminidase__InfluenzaA__AHC58399

SEQ ID NO: 85009 - RNA, 1410 nt, Artificial Sequence; identical to SEQ ID NO: 84979
  derived and/or modified sequence opt1 from neuraminidase__InfluenzaA__AHC58411

SEQ ID NO: 85010 - RNA, 1410 nt, Artificial Sequence; identical to SEQ ID NO: 83930
  derived and/or modified sequence opt1 from neuraminidase__InfluenzaA__AHC58423

SEQ ID NO: 85011 - RNA, 1410 nt, Artificial Sequence; identical to SEQ ID NO: 84983
  derived and/or modified sequence opt1 from neuraminidase__InfluenzaA__AHC58459

SEQ ID NO: 85012 - RNA, 1410 nt, Artificial Sequence
  derived and/or modified sequence opt1 from neuraminidase__InfluenzaA__AHC58471
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugagcgugaagcuggccgggaacuccagccucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagcccguaccgcacgcugauguccugccccaucggcgagguccccagccccuacaacucccgguucgagagcguggccuggagcgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcgccaaccgcccgugggucagcuucaaccagaaccucgaguaccagaucggguacaucugcuccggcguguucggggacaacccccggcccaacgacaagaccggcagcugcggccccguguccagcaacggggccaacggcgucaagggguucuccuucaaguacggcaacgggguguggaucggccgcaccaagagcaucuccagccggaacggcuucgagaugaucugggacccgaacggguggaccggcaccgacaacaacuucagcaucaagcaggacaucguggggaucaacgagugguccggcuacagcggguccuucguccagcaccccgagcugacgggccuggacugcauccgccccugcuucuggguggagcucauccggggccgccccaaggagaacaccaucuggaccagcggguccagcaucuccuucugcggcgucaacagcgacaccguggggugguccuggccggacggcgcggagcugcccuucacgaucgacaaguga

SEQ ID NO: 85013 - RNA, 1410 nt, Artificial Sequence; identical to SEQ ID NO: 84979
  derived and/or modified sequence opt1 from neuraminidase__InfluenzaA__AHC58482

SEQ ID NO: 85014 - RNA, 1410 nt, Artificial Sequence; identical to SEQ ID NO: 84983
  derived and/or modified sequence opt1 from neuraminidase__InfluenzaA__AHC58494

SEQ ID NO: 85015 - RNA, 1410 nt, Artificial Sequence
  derived and/or modified sequence opt1 from neuraminidase__InfluenzaA__AHC58518
augaaccccaaccagaagaucaucaccaucggcagcgugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccgucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccagcaacuccaucgugguguucugcggcacgagcgggaccuacggcaccggguccuggccggacggcgccgaccugaaccucaugcccaucuga

SEQ ID NO: 85016 - RNA, 1410 nt, Artificial Sequence; identical to SEQ ID NO: 84979
  derived and/or modified sequence opt1 from neuraminidase__InfluenzaA__AHC58530

SEQ ID NO: 85017 - RNA, 1410 nt, Artificial Sequence; identical to SEQ ID NO: 84979
  derived and/or modified sequence opt1 from neuraminidase__InfluenzaA__AHC58554

SEQ ID NO: 85018 - RNA, 1410 nt, Artificial Sequence; identical to SEQ ID NO: 84979
  derived and/or modified sequence opt1 from neuraminidase__InfluenzaA__AHC58566

SEQ ID NO: 85019 - RNA, 1410 nt, Artificial Sequence
  derived and/or modified sequence opt1 from neuraminidase__InfluenzaA__AHC58578
augaaccccaaccagaagaucaucaccaucggcagcgugucccugaccgucagcacgaucugcuucuucaugcagaucgccauccucaucaccaccgugacccugcacuucaagcaguacgaguucuacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 85020 - RNA, 1410 nt, Artificial Sequence; identical to SEQ ID NO: 80526
  derived and/or modified sequence opt1 from neuraminidase__InfluenzaA__AHC58590

SEQ ID NO: 85021 - RNA, 1410 nt, Artificial Sequence; identical to SEQ ID NO: 85015
  derived and/or modified sequence opt1 from neuraminidase__InfluenzaA__AHC58602

SEQ ID NO: 85022 - RNA, 1410 nt, Artificial Sequence; identical to SEQ ID NO: 84979
  derived and/or modified sequence opt1 from neuraminidase__InfluenzaA__AHC58614

SEQ ID NO: 85023 - RNA, 1410 nt, Artificial Sequence; identical to SEQ ID NO: 84979
  derived and/or modified sequence opt1 from neuraminidase__InfluenzaA__AHC58626

SEQ ID NO: 85024 - RNA, 1410 nt, Artificial Sequence; identical to SEQ ID NO: 84979
  derived and/or modified sequence opt1 from neuraminidase__InfluenzaA__AHC58638

SEQ ID NO: 85025 - RNA, 1410 nt, Artificial Sequence; identical to SEQ ID NO: 84979
  derived and/or modified sequence opt1 from neuraminidase__InfluenzaA__AHC58650

SEQ ID NO: 85026 - RNA, 1410 nt, Artificial Sequence
  derived and/or modified sequence opt1 from neuraminidase__InfluenzaA__AHC58662
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgaccugaaccucaugcccaucuga

SEQ ID NO: 85027 - RNA, 1410 nt, Artificial Sequence
  derived and/or modified sequence opt1 from neuraminidase__InfluenzaA__AHC58686
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 85028 - RNA, 1410 nt, Artificial Sequence
  derived and/or modified sequence opt1 from neuraminidase__InfluenzaA__AHC58698
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcaccagcgggacguacggcaccggguccuggccggacggcgccgaccugaaccucaugcccaucuga

SEQ ID NO: 85029 - RNA, 1410 nt, Artificial Sequence; identical to SEQ ID NO: 83930
  derived and/or modified sequence opt1 from neuraminidase__InfluenzaA__AHC58710

SEQ ID NO: 85030 - RNA, 1410 nt, Artificial Sequence; identical to SEQ ID NO: 83930
  derived and/or modified sequence opt1 from neuraminidase__InfluenzaA__AHC58722

SEQ ID NO: 85031 - RNA, 1410 nt, Artificial Sequence
  derived and/or modified sequence opt1 from neuraminidase__InfluenzaA__AHC58734
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcauccggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccggcaggucaucguggaccgcggcaaccgguccggguacagcggcaucuucuccguggagggcaagagcugcaucaaccgcugcuucuacgucgagcucauccgggggcgcaaggaggagaccgaggugcuguggaccagcaacuccaucguggucuucugcggcacgagcgggaccuacggcaccggguccuggccggacggcgccgaccugaaccucaugcccaucuga

SEQ ID NO: 85032 - RNA, 1410 nt, Artificial Sequence; identical to SEQ ID NO: 84979
  derived and/or modified sequence opt1 from neuraminidase__InfluenzaA__AHC58746

SEQ ID NO: 85033 - RNA, 1410 nt, Artificial Sequence; identical to SEQ ID NO: 84983
  derived and/or modified sequence opt1 from neuraminidase__InfluenzaA__AHC58758

SEQ ID NO: 85034 - RNA, 1410 nt, Artificial Sequence; identical to SEQ ID NO: 84979
  derived and/or modified sequence opt1 from neuraminidase__InfluenzaA__AHC58770

SEQ ID NO: 85035 - RNA, 1410 nt, Artificial Sequence; identical to SEQ ID NO: 80526
  derived and/or modified sequence opt1 from neuraminidase__InfluenzaA__AHC58782

SEQ ID NO: 85036 - RNA, 1410 nt, Artificial Sequence; identical to SEQ ID NO: 84979
  derived and/or modified sequence opt1 from neuraminidase__InfluenzaA__AHC58806

SEQ ID NO: 85037 - RNA, 1410 nt, Artificial Sequence
  derived and/or modified sequence opt1 from neuraminidase__InfluenzaA__AHC58818
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85038 - RNA, 1410 nt, Artificial Sequence; identical to SEQ ID NO: 85028
  derived and/or modified sequence opt1 from neuraminidase__InfluenzaA__AHC58830

SEQ ID NO: 85039 - RNA, 1410 nt, Artificial Sequence; identical to SEQ ID NO: 84979
  derived and/or modified sequence opt1 from neuraminidase__InfluenzaA__AHC58842

SEQ ID NO: 85040 - RNA, 1410 nt, Artificial Sequence
  derived and/or modified sequence opt1 from neuraminidase__InfluenzaA__AHC58866
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccgcgugaugcugugcgagcccacgaucaucgagcggaacaucaccgagaucguguaccucaccaacaccacgaucgagaaggagaucugccccaagcuggccgaguaccgcaacuggagcaagccgcagugcgacaucaccggguucgcgcccuucuccaaggacaacagcauccggcuguccgccggcggggacaucugggucacccgcgagcccuacgugagcugcgaccccaacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccggcgugcuguggaccagcaacuccaucgucguguucugcgggacgagcggcaccuacgggaccggcuccuggccggacggggccgaccugaaccucaugcccaucuga

SEQ ID NO: 85041 - RNA, 1410 nt, Artificial Sequence; identical to SEQ ID NO: 85028
  derived and/or modified sequence opt1 from neuraminidase__InfluenzaA__AHC58878

SEQ ID NO: 85042 - RNA, 1410 nt, Artificial Sequence; identical to SEQ ID NO: 84979
  derived and/or modified sequence opt1 from neuraminidase__InfluenzaA__AHC58890

SEQ ID NO: 85043 - RNA, 1410 nt, Artificial Sequence; identical to SEQ ID NO: 84983
  derived and/or modified sequence opt1 from neuraminidase__InfluenzaA__AHC58902

SEQ ID NO: 85044 - RNA, 1410 nt, Artificial Sequence; identical to SEQ ID NO: 84979
  derived and/or modified sequence opt1 from neuraminidase__InfluenzaA__AHC58996

SEQ ID NO: 85045 - RNA, 1410 nt, Artificial Sequence; identical to SEQ ID NO: 84979
  derived and/or modified sequence opt1 from neuraminidase__InfluenzaA__AHC59008

SEQ ID NO: 85046 - RNA, 1410 nt, Artificial Sequence; identical to SEQ ID NO: 84983
  derived and/or modified sequence opt1 from neuraminidase__InfluenzaA__AHC59020

SEQ ID NO: 85047 - RNA, 1410 nt, Artificial Sequence
  derived and/or modified sequence opt1 from neuraminidase__InfluenzaA__AHC59032
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccagcguccggugcgugugccgcgacaacuggaagggcuccaaccggccgaucguggacaucaacaucaaggaccacagcaucgucuccagcuacgugugcuccgggcuggugggcgacacgccccgcaagaacgacagcuccagcuccagccacugccucgaccccaacaacgaggagggcgggcacggcgucaaggggugggccuucgacgacggcaacgacguguggauggggcggaccaucaacgagaccucccgccugggcuacgagaccuucaaggucaucgagggcuggagcaaccccaaguccaagcugcagaucaaccgccaggugaucguggaccgggggaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcacguccggcaccuacgggaccggcagcuggccggacggggccgaccugaaccucaugcccaucuga

SEQ ID NO: 85048 - RNA, 1410 nt, Artificial Sequence; identical to SEQ ID NO: 85015
  derived and/or modified sequence opt1 from neuraminidase__InfluenzaA__AHC59044

SEQ ID NO: 85049 - RNA, 1410 nt, Artificial Sequence; identical to SEQ ID NO: 80526
  derived and/or modified sequence opt1 from neuraminidase__InfluenzaA__AHC59056

SEQ ID NO: 85050 - RNA, 1410 nt, Artificial Sequence; identical to SEQ ID NO: 84979
  derived and/or modified sequence opt1 from neuraminidase__InfluenzaA__AHC59068

SEQ ID NO: 85051 - RNA, 1410 nt, Artificial Sequence; identical to SEQ ID NO: 84979
  derived and/or modified sequence opt1 from neuraminidase__InfluenzaA__AHC59080

SEQ ID NO: 85052 - RNA, 1410 nt, Artificial Sequence
  derived and/or modified sequence opt1 from neuraminidase__InfluenzaA__AHC59092
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacacgccccggaagaacgacuccagcuccagcgggcacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggugaucgucgaccgcggggaccggagcggcuacuccgggaucuucagcguggagggcaaguccugcaucaaccggugcuucuacguggagcugauccgcggccggaaggaggagaccgagguccucuggaccagcaacagcaucgugguguucugcgggacguccggcaccuacgggaccggcagcuggcccgacggggccgaccugaaccugaugcccaucuga

SEQ ID NO: 85053 - RNA, 1410 nt, Artificial Sequence
  derived and/or modified sequence opt1 from neuraminidase__InfluenzaA__AHC59104
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucaagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85054 - RNA, 1410 nt, Artificial Sequence
  derived and/or modified sequence opt1 from neuraminidase__InfluenzaA__AHC59116
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcgaggaggagaccgaggugcuguggaccagcaacuccaucgucguguucugcggcacgagcgggaccuacggcaccggguccuggccggacggcgccgaccugaaccucaugcccaucuga

SEQ ID NO: 85055 - RNA, 1410 nt, Artificial Sequence
  derived and/or modified sequence opt1 from neuraminidase__InfluenzaA__AHC59128
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucauggagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 85056 - RNA, 1410 nt, Artificial Sequence
  derived and/or modified sequence opt1 from neuraminidase__InfluenzaA__AHC59152
augaaccccaaccagaagaucaucaccaucggcagcgugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccucgugggcgacacgccccgcaagaacgacuccagcuccagcucccacugccuggaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgaccucaaccugaugcccaucuga

SEQ ID NO: 85057 - RNA, 1410 nt, Artificial Sequence
  derived and/or modified sequence opt1 from neuraminidase__InfluenzaA__AHC59188
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggugacccgggagcccuacguguccugcgacccggacaagugcuaccaguucgcccucggccaggggaccacgcugaacaacguccacagcaacaacaccgugcgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcgucguguccuggagcaaggagauccugcgcacccaggaguccgagugcgugugcaucaacggcacgugcaccgucgugaugaccgacgggagcgccuccggcaaggccgacaccaagauccucuucaucgaggagggcaagaucgugcacacgagcacccugagcggguccgcgcagcacgucgaggagugcagcugcuacccccgguacccgggcgugcgcugcgugugccgggacaacuggaagggguccaaccgccccaucgucgacaucaacaucaaggaccacagcaucguguccagcuacgugugcuccggccuggucggcgacacgccccggaagaacgacagcuccagcuccagccacugccucgaccccaacaacgaggagggcgggcacggggugaagggcugggccuucgacgacgggaacgacgucuggaugggccgcaccaucaacgagaccucccggcugggcuacgagaccuucaaggugaucgagggguggagcaacccgaaguccaagcugcagaucaaccgccaggugaucgucgaccggggcgaccgcagcggguacuccggcaucuucagcguggaggggaaguccugcaucaaccggugcuucuacguggagcucauccgcggccggaaggaggagaccgagguccuguggaccagcaacagcaucgugguguucugcggcacguccgggaccuacggcaccgggagcuggcccgacggcgccgaccugaaccucaugcccaucuga

SEQ ID NO: 85058 - RNA, 1410 nt, Artificial Sequence; identical to SEQ ID NO: 80526
  derived and/or modified sequence opt1 from neuraminidase__InfluenzaA__AHC59200

SEQ ID NO: 85059 - RNA, 1410 nt, Artificial Sequence
  derived and/or modified sequence opt1 from neuraminidase__InfluenzaA__AHC59212
augaaccccaaccagaagaucaucaccaucggcagcgugucccugaccaucagcacgaucugcuucuucaugcagaucgccacccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgaccugaaccucaugcccaucuga

SEQ ID NO: 85060 - RNA, 1410 nt, Artificial Sequence; identical to SEQ ID NO: 84983
  derived and/or modified sequence opt1 from neuraminidase__InfluenzaA__AHC59224

SEQ ID NO: 85061 - RNA, 1410 nt, Artificial Sequence
  derived and/or modified sequence opt1 from neuraminidase__InfluenzaA__AHC59236
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85062 - RNA, 1410 nt, Artificial Sequence; identical to SEQ ID NO: 84983
  derived and/or modified sequence opt1 from neuraminidase__InfluenzaA__AHC59260

SEQ ID NO: 85063 - RNA, 1410 nt, Artificial Sequence; identical to SEQ ID NO: 84979
  derived and/or modified sequence opt1 from neuraminidase__InfluenzaA__AHC59272

SEQ ID NO: 85064 - RNA, 1410 nt, Artificial Sequence; identical to SEQ ID NO: 84983
  derived and/or modified sequence opt1 from neuraminidase__InfluenzaA__AHC59284

SEQ ID NO: 85065 - RNA, 1410 nt, Artificial Sequence
  derived and/or modified sequence opt1 from neuraminidase__InfluenzaA__AHC59296
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaagaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85066 - RNA, 1410 nt, Artificial Sequence
  derived and/or modified sequence opt1 from neuraminidase__InfluenzaA__AHC59308
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugagcgccggcggggacaucugggucacccgggagcccuacguguccugcgacccgaacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggaagcugguggacagcguggucuccuggagcaaggagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggaccacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaacccgaaguccaagcugcagaucaaccgccaggugaugguggaccggggcaaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggcccgacggcgccgaccugaaccucaugcccaucuga

SEQ ID NO: 85067 - RNA, 1410 nt, Artificial Sequence; identical to SEQ ID NO: 84891
  derived and/or modified sequence opt1 from neuraminidase__InfluenzaA__AHC59320

SEQ ID NO: 85068 - RNA, 1410 nt, Artificial Sequence; identical to SEQ ID NO: 83154
  derived and/or modified sequence opt1 from neuraminidase__InfluenzaA__AHC59332

SEQ ID NO: 85069 - RNA, 1410 nt, Artificial Sequence; identical to SEQ ID NO: 85027
  derived and/or modified sequence opt1 from neuraminidase__InfluenzaA__AHC59344

SEQ ID NO: 85070 - RNA, 1410 nt, Artificial Sequence
  derived and/or modified sequence opt1 from neuraminidase__InfluenzaA__AHC59368
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucgacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85071 - RNA, 1410 nt, Artificial Sequence; identical to SEQ ID NO: 84979
  derived and/or modified sequence opt1 from neuraminidase__InfluenzaA__AHC59380

SEQ ID NO: 85072 - RNA, 1410 nt, Artificial Sequence; identical to SEQ ID NO: 83930
  derived and/or modified sequence opt1 from neuraminidase__InfluenzaA__AHC59392

SEQ ID NO: 85073 - RNA, 1410 nt, Artificial Sequence; identical to SEQ ID NO: 85015
  derived and/or modified sequence opt1 from neuraminidase__InfluenzaA__AHC59404

SEQ ID NO: 85074 - RNA, 1410 nt, Artificial Sequence; identical to SEQ ID NO: 84983
  derived and/or modified sequence opt1 from neuraminidase__InfluenzaA__AHC59416

SEQ ID NO: 85075 - RNA, 1410 nt, Artificial Sequence
  derived and/or modified sequence opt1 from neuraminidase__InfluenzaA__AHC59428
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgaccgcugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcgccugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85076 - RNA, 1410 nt, Artificial Sequence
  derived and/or modified sequence opt1 from neuraminidase__InfluenzaA__AHC59440
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcagacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85077 - RNA, 1410 nt, Artificial Sequence; identical to SEQ ID NO: 84983
  derived and/or modified sequence opt1 from neuraminidase__InfluenzaA__AHC59452

SEQ ID NO: 85078 - RNA, 1410 nt, Artificial Sequence; identical to SEQ ID NO: 80526
  derived and/or modified sequence opt1 from neuraminidase__InfluenzaA__AHC59464

SEQ ID NO: 85079 - RNA, 1410 nt, Artificial Sequence; identical to SEQ ID NO: 84891
  derived and/or modified sequence opt1 from neuraminidase__InfluenzaA__AHC59476

SEQ ID NO: 85080 - RNA, 1410 nt, Artificial Sequence; identical to SEQ ID NO: 84983
  derived and/or modified sequence opt1 from neuraminidase__InfluenzaA__AHC59488

SEQ ID NO: 85081 - RNA, 1410 nt, Artificial Sequence; identical to SEQ ID NO: 84983
  derived and/or modified sequence opt1 from neuraminidase__InfluenzaA__AHC59500

SEQ ID NO: 85082 - RNA, 1410 nt, Artificial Sequence; identical to SEQ ID NO: 85028
  derived and/or modified sequence opt1 from neuraminidase__InfluenzaA__AHC59512

SEQ ID NO: 85083 - RNA, 1410 nt, Artificial Sequence; identical to SEQ ID NO: 85028
  derived and/or modified sequence opt1 from neuraminidase__InfluenzaA__AHC59524

SEQ ID NO: 85084 - RNA, 1410 nt, Artificial Sequence; identical to SEQ ID NO: 85015
  derived and/or modified sequence opt1 from neuraminidase__InfluenzaA__AHC59536

SEQ ID NO: 85085 - RNA, 1410 nt, Artificial Sequence; identical to SEQ ID NO: 84983
  derived and/or modified sequence opt1 from neuraminidase__InfluenzaA__AHC59548

SEQ ID NO: 85086 - RNA, 1410 nt, Artificial Sequence; identical to SEQ ID NO: 84983
  derived and/or modified sequence opt1 from neuraminidase__InfluenzaA__AHC59560

SEQ ID NO: 85087 - RNA, 1410 nt, Artificial Sequence; identical to SEQ ID NO: 85061
  derived and/or modified sequence opt1 from neuraminidase__InfluenzaA__AHC59572

SEQ ID NO: 85088 - RNA, 1410 nt, Artificial Sequence; identical to SEQ ID NO: 85056
  derived and/or modified sequence opt1 from neuraminidase__InfluenzaA__AHC59584

SEQ ID NO: 85089 - RNA, 1410 nt, Artificial Sequence; identical to SEQ ID NO: 85028
  derived and/or modified sequence opt1 from neuraminidase__InfluenzaA__AHC59596

SEQ ID NO: 85090 - RNA, 1410 nt, Artificial Sequence; identical to SEQ ID NO: 83930
  derived and/or modified sequence opt1 from neuraminidase__InfluenzaA__AHC59608

SEQ ID NO: 85091 - RNA, 1410 nt, Artificial Sequence; identical to SEQ ID NO: 85015
  derived and/or modified sequence opt1 from neuraminidase__InfluenzaA__AHC59620

SEQ ID NO: 85092 - RNA, 1410 nt, Artificial Sequence; identical to SEQ ID NO: 84983
  derived and/or modified sequence opt1 from neuraminidase__InfluenzaA__AHC59632

SEQ ID NO: 85093 - RNA, 1410 nt, Artificial Sequence; identical to SEQ ID NO: 84983
  derived and/or modified sequence opt1 from neuraminidase__InfluenzaA__AHC59644

SEQ ID NO: 85094 - RNA, 1410 nt, Artificial Sequence
  derived and/or modified sequence opt1 from neuraminidase__InfluenzaA__AHC59656
augaaccccaaccagaagaucaucaccaucggcagcgugucccugaccaucagcacgaucugcuucuucaugcagaucgccauccucaucaccaccgucaccaugcacuucaagcaguacgaguucaacuccccgcccaacaaccaggugaugcugugcgagcccacgaucaucgagcgcaacaucaccgagaucguguaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgugaagugcuaccaguucgcccugggccaggggaccacgcucaacaacguccacuccaacaacaccgugcgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggaagcucguggacuccgucgugagcugguccaaggagauccugcggacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccuggaccccaacaacgaggagggcgggcacggggugaagggcugggccuucgacgacgggaacgacgucuggaugggccggaccaucaacgagaccagccgccucggcuacgagaccuucaaggugaucgaggggugguccaaccccaagagcaagcugcagaucaaccgccaggugaucgucgaccggggcaaccgguccggguacagcggcaucuucuccguggagggcaagagcugcaucaaccgcugcuucuacguggagcugauccgggggcgcaaggaggagaccgagguccucuggaccagcaacuccaucgugguguucugcggcacgagcgggaccuacggcaccggguccuggccggacggcgccgaccugaaccugaugcccaucuga

SEQ ID NO: 85095 - RNA, 1410 nt, Artificial Sequence; identical to SEQ ID NO: 85028
  derived and/or modified sequence opt1 from neuraminidase__InfluenzaA__AHC59668

SEQ ID NO: 85096 - RNA, 1410 nt, Artificial Sequence; identical to SEQ ID NO: 85056
  derived and/or modified sequence opt1 from neuraminidase__InfluenzaA__AHC59680

SEQ ID NO: 85097 - RNA, 1410 nt, Artificial Sequence; identical to SEQ ID NO: 84983
  derived and/or modified sequence opt1 from neuraminidase__InfluenzaA__AHC59704

SEQ ID NO: 85098 - RNA, 1410 nt, Artificial Sequence; identical to SEQ ID NO: 80526
  derived and/or modified sequence opt1 from neuraminidase__InfluenzaA__AHC59716

SEQ ID NO: 85099 - RNA, 1410 nt, Artificial Sequence; identical to SEQ ID NO: 80526
  derived and/or modified sequence opt1 from neuraminidase__InfluenzaA__AHC59728

SEQ ID NO: 85100 - RNA, 1410 nt, Artificial Sequence; identical to SEQ ID NO: 85028
  derived and/or modified sequence opt1 from neuraminidase__InfluenzaA__AHC59752

SEQ ID NO: 85101 - RNA, 1410 nt, Artificial Sequence; identical to SEQ ID NO: 85015
  derived and/or modified sequence opt1 from neuraminidase__InfluenzaA__AHC59764

SEQ ID NO: 85102 - RNA, 1410 nt, Artificial Sequence
  derived and/or modified sequence opt1 from neuraminidase__InfluenzaA__AHC59776
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85103 - RNA, 1410 nt, Artificial Sequence; identical to SEQ ID NO: 84979
  derived and/or modified sequence opt1 from neuraminidase__InfluenzaA__AHC59788

SEQ ID NO: 85104 - RNA, 1410 nt, Artificial Sequence; identical to SEQ ID NO: 85056
  derived and/or modified sequence opt1 from neuraminidase__InfluenzaA__AHC59800

SEQ ID NO: 85105 - RNA, 1410 nt, Artificial Sequence
  derived and/or modified sequence opt1 from neuraminidase__InfluenzaA__AHC59812
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucguguacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 85106 - RNA, 1410 nt, Artificial Sequence
  derived and/or modified sequence opt1 from neuraminidase__InfluenzaA__AHC59824
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaaguggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85107 - RNA, 1410 nt, Artificial Sequence; identical to SEQ ID NO: 84983
  derived and/or modified sequence opt1 from neuraminidase__InfluenzaA__AHC59836

SEQ ID NO: 85108 - RNA, 1410 nt, Artificial Sequence; identical to SEQ ID NO: 83930
  derived and/or modified sequence opt1 from neuraminidase__InfluenzaA__AHC59848

SEQ ID NO: 85109 - RNA, 1410 nt, Artificial Sequence; identical to SEQ ID NO: 84979
  derived and/or modified sequence opt1 from neuraminidase__InfluenzaA__AHC59860

SEQ ID NO: 85110 - RNA, 1410 nt, Artificial Sequence; identical to SEQ ID NO: 85026
  derived and/or modified sequence opt1 from neuraminidase__InfluenzaA__AHC59872

SEQ ID NO: 85111 - RNA, 1410 nt, Artificial Sequence; identical to SEQ ID NO: 85015
  derived and/or modified sequence opt1 from neuraminidase__InfluenzaA__AHC59884

SEQ ID NO: 85112 - RNA, 1410 nt, Artificial Sequence
  derived and/or modified sequence opt1 from neuraminidase__InfluenzaA__AHC59895
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85113 - RNA, 1410 nt, Artificial Sequence; identical to SEQ ID NO: 84983
  derived and/or modified sequence opt1 from neuraminidase__InfluenzaA__AHC59907

SEQ ID NO: 85114 - RNA, 1410 nt, Artificial Sequence
  derived and/or modified sequence opt1 from neuraminidase__InfluenzaA__AHC59918
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaugaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85115 - RNA, 1410 nt, Artificial Sequence; identical to SEQ ID NO: 85114
  derived and/or modified sequence opt1 from neuraminidase__InfluenzaA__AHC59930

SEQ ID NO: 85116 - RNA, 1410 nt, Artificial Sequence; identical to SEQ ID NO: 84983
  derived and/or modified sequence opt1 from neuraminidase__InfluenzaA__AHC59942

SEQ ID NO: 85117 - RNA, 1410 nt, Artificial Sequence; identical to SEQ ID NO: 85028
  derived and/or modified sequence opt1 from neuraminidase__InfluenzaA__AHC59954

SEQ ID NO: 85118 - RNA, 1410 nt, Artificial Sequence
  derived and/or modified sequence opt1 from neuraminidase__InfluenzaA__AHC59966
augaaccccaaccagaagaucaucaccaucggcagcgugucccugaccaucagcacgaucugcuucuucaugcagaucgccauccucaucaccaccgucacccugcacuucaagcaguacgaguucaacuccagcccgaacaaccaggugaugcugugcgagcccacgaucaucgagcgcaacaucaccgagaucguguaccucaccaacaccacgaucgagaaggagaucugccccaagcccgccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccugggccaggggaccacgcucaacaacgugcacagcaacaacaccguccgcgaccggaccccguaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcguggucuccuggagcaaggagauccugcgcacccaggaguccgagugcgugugcaucaacggcacgugcaccguggucaugaccgacgggagcgccagcggcaaggccgacaccaagauccuguucaucgaggagggcaagaucgugcacacguccacccucagcggguccgcgcagcacguggaggagugcagcugcuacccccgguaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccuggaccccaacaacgaggagggcgggcacggggucaagggcugggccuucgacgacgggaacgacguguggaugggccgcaccaucaacgagaccucccggcucggcuacgagaccuucaaggucaucgagggguggagcaaccccaaguccaagcugcagaucaaccgccaggugaucguggaccggggcgacgggagcggcuacuccgggaucuucagcgucgagggcaagagcugcaucaaccgcugcuucuacguggagcugauccggggccgcaaggaggagaccgaggugcucuggaccuccaacagcaucgucguguucugcgggacguccggcaccuacgggaccggcagcuggccggacggggccgaccugaaccugaugcccaucuga

SEQ ID NO: 85119 - RNA, 1410 nt, Artificial Sequence; identical to SEQ ID NO: 83930
  derived and/or modified sequence opt1 from neuraminidase__InfluenzaA__AHC59978

SEQ ID NO: 85120 - RNA, 1410 nt, Artificial Sequence; identical to SEQ ID NO: 81892
  derived and/or modified sequence opt1 from neuraminidase__InfluenzaA__AHC59990

SEQ ID NO: 85121 - RNA, 1410 nt, Artificial Sequence; identical to SEQ ID NO: 85028
  derived and/or modified sequence opt1 from neuraminidase__InfluenzaA__AHC60002

SEQ ID NO: 85122 - RNA, 1410 nt, Artificial Sequence; identical to SEQ ID NO: 84983
  derived and/or modified sequence opt1 from neuraminidase__InfluenzaA__AHC60014

SEQ ID NO: 85123 - RNA, 1410 nt, Artificial Sequence; identical to SEQ ID NO: 80526
  derived and/or modified sequence opt1 from neuraminidase__InfluenzaA__AHC60026

SEQ ID NO: 85124 - RNA, 1410 nt, Artificial Sequence; identical to SEQ ID NO: 84979
  derived and/or modified sequence opt1 from neuraminidase__InfluenzaA__AHC60038

SEQ ID NO: 85125 - RNA, 1410 nt, Artificial Sequence; identical to SEQ ID NO: 84979
  derived and/or modified sequence opt1 from neuraminidase__InfluenzaA__AHC60050

SEQ ID NO: 85126 - RNA, 1410 nt, Artificial Sequence
  derived and/or modified sequence opt1 from neuraminidase__InfluenzaA__AHC60062
augaaccccaaccagaagaucaucaccaucggcagcgugucccugaccaucagcacgaucugcuucuucaugcagaucgccauccucaucaccaccgucaccaugcacuucaagcaguacgaguucaacuccccgcccaacaaccaggugaugcugugcgagcccacgaucaucgagcgcaacaucaccgagaucguguaccugaccaacaccacgaucgagaaggagaucugccccaagcucgccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccugggccaggggaccacgcucaacaacgugcacuccaacaacaccguccgcgaccggaccccguaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggaagcucguggacuccguggucagcugguccaaggagauccugcggacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccuggaccccaacaacgaggagggcgggcacggggucaagggcugggccuucgacgacgggaacgacguguggaugggccggaccaucaacgagaccagccgccucggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggccggacggcgccgaccugaaccugaugcccaucuga

SEQ ID NO: 85127 - RNA, 1410 nt, Artificial Sequence; identical to SEQ ID NO: 83930
  derived and/or modified sequence opt1 from neuraminidase__InfluenzaA__AHC60074

SEQ ID NO: 85128 - RNA, 1410 nt, Artificial Sequence; identical to SEQ ID NO: 84983
  derived and/or modified sequence opt1 from neuraminidase__InfluenzaA__AHC60086

SEQ ID NO: 85129 - RNA, 1410 nt, Artificial Sequence
  derived and/or modified sequence opt1 from neuraminidase__InfluenzaA__AHC60098
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucgacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85130 - RNA, 1410 nt, Artificial Sequence; identical to SEQ ID NO: 84979
  derived and/or modified sequence opt1 from neuraminidase__InfluenzaA__AHC60110

SEQ ID NO: 85131 - RNA, 1410 nt, Artificial Sequence; identical to SEQ ID NO: 85056
  derived and/or modified sequence opt1 from neuraminidase__InfluenzaA__AHC60122

SEQ ID NO: 85132 - RNA, 1410 nt, Artificial Sequence; identical to SEQ ID NO: 84983
  derived and/or modified sequence opt1 from neuraminidase__InfluenzaA__AHC60134

SEQ ID NO: 85133 - RNA, 1410 nt, Artificial Sequence; identical to SEQ ID NO: 85037
  derived and/or modified sequence opt1 from neuraminidase__InfluenzaA__AHC60146

SEQ ID NO: 85134 - RNA, 1410 nt, Artificial Sequence; identical to SEQ ID NO: 85114
  derived and/or modified sequence opt1 from neuraminidase__InfluenzaA__AHC60158

SEQ ID NO: 85135 - RNA, 1410 nt, Artificial Sequence; identical to SEQ ID NO: 84979
  derived and/or modified sequence opt1 from neuraminidase__InfluenzaA__AHC60182

SEQ ID NO: 85136 - RNA, 1410 nt, Artificial Sequence
  derived and/or modified sequence opt1 from neuraminidase__InfluenzaA__AHC60206
augaaccccaaccagaagaucaucaccaucggcagcgugucccugaccaucagcaucaucugcuucuucaugcaggucgccauccucaucacgaccgugacccugcacuucaagcaguacgaguucaacuccccgcccaacaaccaggugaugcugugcgagcccaccaucaucgagcgcaacaucacggagaucgucuaccucaccaacaccaccaucgagaaggagaucugccccaagcuggccgaguaccggaacuggagcaagccgcagugcgacaucacgggguucgcgcccuucuccaaggacaacagcauccgccuguccgccggcggggacaucugggugacccgggagcccuacgugagcugcgaccccgacaagugcuaccaguucgcccucggccaggggaccacccugaacaacguccacuccaacaacacggugcgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggaagcugguggacuccgucgugagcugguccaaggagauccugcggacccaggagagcgagugcgugugcaucaacgggaccugcacggucgugaugaccgacggguccgccagcggcaaggccgacaccaagauccucuucaucgaggagggcaagaucgugcacaccagcacgcuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccucgaccccaacaacgaggagggcggccacggggugaagggcugggccuucgacgacgggaacgacgucuggaugggccggaccaucaacgagaccagccgccugggcuacgagaccuucaaggugaucgaggggugguccaaccccaagagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccagcaacuccaucgugguguucugcggcaccagcgggacguacggcaccggguccuggccggacggcgccgaccugaaccucaugcccaucuga

SEQ ID NO: 85137 - RNA, 1410 nt, Artificial Sequence; identical to SEQ ID NO: 83930
  derived and/or modified sequence opt1 from neuraminidase__InfluenzaA__AHC60218

SEQ ID NO: 85138 - RNA, 1410 nt, Artificial Sequence; identical to SEQ ID NO: 80526
  derived and/or modified sequence opt1 from neuraminidase__InfluenzaA__AHC60230

SEQ ID NO: 85139 - RNA, 1410 nt, Artificial Sequence; identical to SEQ ID NO: 84979
  derived and/or modified sequence opt1 from neuraminidase__InfluenzaA__AHC60242

SEQ ID NO: 85140 - RNA, 1410 nt, Artificial Sequence; identical to SEQ ID NO: 84979
  derived and/or modified sequence opt1 from neuraminidase__InfluenzaA__AHC60254

SEQ ID NO: 85141 - RNA, 1410 nt, Artificial Sequence; identical to SEQ ID NO: 84979
  derived and/or modified sequence opt1 from neuraminidase__InfluenzaA__AHC60266

SEQ ID NO: 85142 - RNA, 1410 nt, Artificial Sequence; identical to SEQ ID NO: 85028
  derived and/or modified sequence opt1 from neuraminidase__InfluenzaA__AHC60278

SEQ ID NO: 85143 - RNA, 1410 nt, Artificial Sequence; identical to SEQ ID NO: 84979
  derived and/or modified sequence opt1 from neuraminidase__InfluenzaA__AHC60290

SEQ ID NO: 85144 - RNA, 1410 nt, Artificial Sequence
  derived and/or modified sequence opt1 from neuraminidase__InfluenzaA__AHC60302
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucauccacacgagcacccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccggcaggucaucguggaccgcggcaaccgguccggguacagcggcaucuucuccguggagggcaagagcugcaucaaccgcugcuucuacgucgagcucauccgggggcgcaaggaggagaccgaggugcuguggaccagcaacuccaucguggucuucugcggcacgagcgggaccuacggcaccggguccuggccggacggcgccgaccugaaccucaugcccaucuga

SEQ ID NO: 85145 - RNA, 1410 nt, Artificial Sequence; identical to SEQ ID NO: 84979
  derived and/or modified sequence opt1 from neuraminidase__InfluenzaA__AHC60314

SEQ ID NO: 85146 - RNA, 1410 nt, Artificial Sequence; identical to SEQ ID NO: 84979
  derived and/or modified sequence opt1 from neuraminidase__InfluenzaA__AHC60326

SEQ ID NO: 85147 - RNA, 1410 nt, Artificial Sequence
  derived and/or modified sequence opt1 from neuraminidase__InfluenzaA__AHC60338
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacggggacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85148 - RNA, 1410 nt, Artificial Sequence; identical to SEQ ID NO: 81892
  derived and/or modified sequence opt1 from neuraminidase__InfluenzaA__AHC60350

SEQ ID NO: 85149 - RNA, 1410 nt, Artificial Sequence
  derived and/or modified sequence opt1 from neuraminidase__InfluenzaA__AHC60362
augaaccccaaccagaagaucaucaccaucggcagcgugucccugaccaucagcacgaucugcuucuucaugcaggucgccauccucaucaccaccgugacccugcacuucaagcaguacgaguucaacuccccgcccaacaaccaggugaugcugugcaagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccgucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaucaaccgccaggugaucgucgaccggggcaaccgguccggguacagcggcaucuucuccguggagggcaagagcugcaucaaccgcugcuucuacguggagcucauccgggggcgcaaggaggagaccgagguccuguggaccagcaacuccaucgugguguucugcggcacgagcgggaccuacggcaccggguccuggccggacggcgccgaccugaaccucaugcccaucuga

SEQ ID NO: 85150 - RNA, 1410 nt, Artificial Sequence; identical to SEQ ID NO: 84891
  derived and/or modified sequence opt1 from neuraminidase__InfluenzaA__AHC60374

SEQ ID NO: 85151 - RNA, 1410 nt, Artificial Sequence; identical to SEQ ID NO: 80526
  derived and/or modified sequence opt1 from neuraminidase__InfluenzaA__AHC60386

SEQ ID NO: 85152 - RNA, 1410 nt, Artificial Sequence; identical to SEQ ID NO: 84983
  derived and/or modified sequence opt1 from neuraminidase__InfluenzaA__AHC60398

SEQ ID NO: 85153 - RNA, 1410 nt, Artificial Sequence; identical to SEQ ID NO: 85015
  derived and/or modified sequence opt1 from neuraminidase__InfluenzaA__AHC60410

SEQ ID NO: 85154 - RNA, 1410 nt, Artificial Sequence; identical to SEQ ID NO: 80526
  derived and/or modified sequence opt1 from neuraminidase__InfluenzaA__AHC60422

SEQ ID NO: 85155 - RNA, 1410 nt, Artificial Sequence; identical to SEQ ID NO: 85015
  derived and/or modified sequence opt1 from neuraminidase__InfluenzaA__AHC60434

SEQ ID NO: 85156 - RNA, 1410 nt, Artificial Sequence; identical to SEQ ID NO: 84983
  derived and/or modified sequence opt1 from neuraminidase__InfluenzaA__AHC60446

SEQ ID NO: 85157 - RNA, 1410 nt, Artificial Sequence
  derived and/or modified sequence opt1 from neuraminidase__InfluenzaA__AHC60458
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacggguccagcuccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaaguccugcaucaaccggugcuucuacguggagcucauccgcggccggaaggaggagaccgaggugcuguggaccagcaacagcaucgucguguucugcgggaccuccggcacguacgggaccggcagcuggccggacggggccgaccugaaccucaugcccaucuga

SEQ ID NO: 85158 - RNA, 1410 nt, Artificial Sequence; identical to SEQ ID NO: 85028
  derived and/or modified sequence opt1 from neuraminidase__InfluenzaA__AHC60470

SEQ ID NO: 85159 - RNA, 1410 nt, Artificial Sequence
  derived and/or modified sequence opt1 from neuraminidase__InfluenzaA__AHC60482
augaaccccaaccagaagaucaucaccaucggcagcgugucccugaccaucagcacgaucugcuucuucaugcagaucgccauccucaccaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggacgacccucaacaacgugcacuccaacaacaccguccgcgaccggacccccuaccgcacgcugcugaugaacgagcucggcgugcccuuccaccugggcaccaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacgcaggagagcgagugcgugugcaucaacgggaccugcaccguggucaugaccgacggguccgccagcggcaaggccgacacgaagauccuguucaucgaggagggcaagaucgugcacaccagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcggccacggggucaagggcugggccuucgacgacgggaacgacguguggaugggccgcacgaucaacgagaccagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggacgagcaacuccaucgucguguucugcggcaccagcgggaccuacggcaccggguccuggcccgacggcgccgaccugaaccugaugcccaucuga

SEQ ID NO: 85160 - RNA, 1410 nt, Artificial Sequence; identical to SEQ ID NO: 84979
  derived and/or modified sequence opt1 from neuraminidase__InfluenzaA__AHC60494

SEQ ID NO: 85161 - RNA, 1410 nt, Artificial Sequence; identical to SEQ ID NO: 84979
  derived and/or modified sequence opt1 from neuraminidase__InfluenzaA__AHC60506

SEQ ID NO: 85162 - RNA, 1410 nt, Artificial Sequence; identical to SEQ ID NO: 84983
  derived and/or modified sequence opt1 from neuraminidase__InfluenzaA__AHC60518

SEQ ID NO: 85163 - RNA, 1410 nt, Artificial Sequence; identical to SEQ ID NO: 84983
  derived and/or modified sequence opt1 from neuraminidase__InfluenzaA__AHC60542

SEQ ID NO: 85164 - RNA, 1410 nt, Artificial Sequence
  derived and/or modified sequence opt1 from neuraminidase__InfluenzaA__AHC60554
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaugaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccgggaccuggccggacggcgccgaccugaaccucaugcccaucuga

SEQ ID NO: 85165 - RNA, 1410 nt, Artificial Sequence
  derived and/or modified sequence opt1 from neuraminidase__InfluenzaA__AHC60566
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcuccaggugaaccgccaggugaucgucgaccggggcgaccgcuccggguacagcggcaucuucuccguggagggcaagagcugcaucaaccggugcuucuacguggagcugauccgcgggcggaaggaggagaccgagguccuguggaccagcaacuccaucgugguguucugcggcacgagcgggaccuacggcaccggguccuggcccgacggcgccgaccugaaccugaugcccaucuga

SEQ ID NO: 85166 - RNA, 1410 nt, Artificial Sequence; identical to SEQ ID NO: 83930
  derived and/or modified sequence opt1 from neuraminidase__InfluenzaA__AHC60578

SEQ ID NO: 85167 - RNA, 1410 nt, Artificial Sequence; identical to SEQ ID NO: 84979
  derived and/or modified sequence opt1 from neuraminidase__InfluenzaA__AHC60590

SEQ ID NO: 85168 - RNA, 1410 nt, Artificial Sequence
  derived and/or modified sequence opt1 from neuraminidase__InfluenzaA__AHC60602
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcccgccgaguaccggaacugguccaagccccagugcgacaucaccggguucgcgcccuucagcaaggacaacuccauccgccugagcgccggcggggacaucugggugacccgggagccguacguguccugcgaccccgacaagugcuaccaguucgcccugggccaggggaccacgcucaacaacguccacagcaacaacaccgugcgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcgucguguccuggagcaaggagauccugcgcacccaggaguccgagugcgugugcaucaacggcacgugcaccgucgugaugaccgacgggagcgccuccggcaaggccgacaccaagauccuguucaucgaggagggcaagaucgugcacacgagcacccucagcggguccgcgcagcacgucgaggagugcagcugcuacccgcgguaccccggcgugcgcugcgugugccgggacaacuggaagggguccaaccgccccaucgucgacaucaacaucaaggaccacagcaucguguccagcuacgugugcuccggccuggucggcgacacgccccggaagaacgacagcuccagcuccagccacugccuggacccgaacaacgaggagggcgggcacggggugaagggcugggccuucgacgacgggaacgacgucuggaugggccgcaccaucaacgagaccucccggcucggcuacgagaccuucaaggugaucgagggguggagcaaccccaaguccaagcugcagaucaaccgccaggugaucgucgaccggggcgaccgcagcggguacuccggcaucuucagcguggaggggaaguccugcaucaaccggugcuucuacguggagcugauccgcggccggaaggaggagaccgagguccucuggaccagcaacagcaucgugguguucugcggcacguccgggaccuacggcaccgggagcuggcccgacggcgccgaccugaaccugaugcccaucuga

SEQ ID NO: 85169 - RNA, 1410 nt, Artificial Sequence; identical to SEQ ID NO: 80526
  derived and/or modified sequence opt1 from neuraminidase__InfluenzaA__AHC60614

SEQ ID NO: 85170 - RNA, 1410 nt, Artificial Sequence; identical to SEQ ID NO: 83930
  derived and/or modified sequence opt1 from neuraminidase__InfluenzaA__AHC60626

SEQ ID NO: 85171 - RNA, 1410 nt, Artificial Sequence
  derived and/or modified sequence opt1 from neuraminidase__InfluenzaA__AHC60650
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacgagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85172 - RNA, 1410 nt, Artificial Sequence; identical to SEQ ID NO: 85028
  derived and/or modified sequence opt1 from neuraminidase__InfluenzaA__AHC60662

SEQ ID NO: 85173 - RNA, 1410 nt, Artificial Sequence; identical to SEQ ID NO: 84983
  derived and/or modified sequence opt1 from neuraminidase__InfluenzaA__AHC60674

SEQ ID NO: 85174 - RNA, 1410 nt, Artificial Sequence; identical to SEQ ID NO: 80526
  derived and/or modified sequence opt1 from neuraminidase__InfluenzaA__AHC60686

SEQ ID NO: 85175 - RNA, 1410 nt, Artificial Sequence; identical to SEQ ID NO: 84983
  derived and/or modified sequence opt1 from neuraminidase__InfluenzaA__AHC60698

SEQ ID NO: 85176 - RNA, 1410 nt, Artificial Sequence; identical to SEQ ID NO: 84979
  derived and/or modified sequence opt1 from neuraminidase__InfluenzaA__AHC60710

SEQ ID NO: 85177 - RNA, 1410 nt, Artificial Sequence; identical to SEQ ID NO: 85028
  derived and/or modified sequence opt1 from neuraminidase__InfluenzaA__AHC60722

SEQ ID NO: 85178 - RNA, 1410 nt, Artificial Sequence
  derived and/or modified sequence opt1 from neuraminidase__InfluenzaA__AHC60734
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaucaacaccaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccaacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggaagcugguggacuccguggucagcugguccaaggagauccugcggacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 85179 - RNA, 1410 nt, Artificial Sequence; identical to SEQ ID NO: 85015
  derived and/or modified sequence opt1 from neuraminidase__InfluenzaA__AHC60746

SEQ ID NO: 85180 - RNA, 1410 nt, Artificial Sequence; identical to SEQ ID NO: 85114
  derived and/or modified sequence opt1 from neuraminidase__InfluenzaA__AHC60770

SEQ ID NO: 85181 - RNA, 1410 nt, Artificial Sequence
  derived and/or modified sequence opt1 from neuraminidase__InfluenzaA__AHC60782
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcggcuacgugugcuccggccuggugggggacacgccccggaagaacgacagcuccagcuccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaaguccugcaucaaccggugcuucuacguggagcucauccgcggccggaaggaggagaccgaggugcuguggaccagcaacagcaucgucguguucugcgggacguccggcaccuacgggaccggcagcuggccggacggggccgaccugaaccucaugcccaucuga

SEQ ID NO: 85182 - RNA, 1410 nt, Artificial Sequence; identical to SEQ ID NO: 85026
  derived and/or modified sequence opt1 from neuraminidase__InfluenzaA__AHC60794

SEQ ID NO: 85183 - RNA, 1410 nt, Artificial Sequence
  derived and/or modified sequence opt1 from neuraminidase__InfluenzaA__AHC60806
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccggcgugcuguggaccagcaacuccaucgucguguucugcgggacgagcggcaccuacgggaccggcuccuggccggacggggccgaccugaaccucaugcccaucuga

SEQ ID NO: 85184 - RNA, 1410 nt, Artificial Sequence; identical to SEQ ID NO: 81892
  derived and/or modified sequence opt1 from neuraminidase__InfluenzaA__AHC60818

SEQ ID NO: 85185 - RNA, 1410 nt, Artificial Sequence; identical to SEQ ID NO: 84983
  derived and/or modified sequence opt1 from neuraminidase__InfluenzaA__AHC60830

SEQ ID NO: 85186 - RNA, 1410 nt, Artificial Sequence; identical to SEQ ID NO: 85164
  derived and/or modified sequence opt1 from neuraminidase__InfluenzaA__AHC60842

SEQ ID NO: 85187 - RNA, 1410 nt, Artificial Sequence; identical to SEQ ID NO: 84983
  derived and/or modified sequence opt1 from neuraminidase__InfluenzaA__AHC60854

SEQ ID NO: 85188 - RNA, 1410 nt, Artificial Sequence; identical to SEQ ID NO: 85028
  derived and/or modified sequence opt1 from neuraminidase__InfluenzaA__AHC60866

SEQ ID NO: 85189 - RNA, 1410 nt, Artificial Sequence; identical to SEQ ID NO: 85015
  derived and/or modified sequence opt1 from neuraminidase__InfluenzaA__AHC60878

SEQ ID NO: 85190 - RNA, 1410 nt, Artificial Sequence; identical to SEQ ID NO: 85015
  derived and/or modified sequence opt1 from neuraminidase__InfluenzaA__AHC60890

SEQ ID NO: 85191 - RNA, 1410 nt, Artificial Sequence; identical to SEQ ID NO: 85114
  derived and/or modified sequence opt1 from neuraminidase__InfluenzaA__AHC60902

SEQ ID NO: 85192 - RNA, 1410 nt, Artificial Sequence; identical to SEQ ID NO: 84979
  derived and/or modified sequence opt1 from neuraminidase__InfluenzaA__AHC60914

SEQ ID NO: 85193 - RNA, 1410 nt, Artificial Sequence; identical to SEQ ID NO: 84983
  derived and/or modified sequence opt1 from neuraminidase__InfluenzaA__AHC60926

SEQ ID NO: 85194 - RNA, 1410 nt, Artificial Sequence; identical to SEQ ID NO: 84979
  derived and/or modified sequence opt1 from neuraminidase__InfluenzaA__AHC60938

SEQ ID NO: 85195 - RNA, 1410 nt, Artificial Sequence; identical to SEQ ID NO: 84983
  derived and/or modified sequence opt1 from neuraminidase__InfluenzaA__AHC60950

SEQ ID NO: 85196 - RNA, 1410 nt, Artificial Sequence
  derived and/or modified sequence opt1 from neuraminidase__InfluenzaA__AHC60962
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 85197 - RNA, 1410 nt, Artificial Sequence; identical to SEQ ID NO: 85028
  derived and/or modified sequence opt1 from neuraminidase__InfluenzaA__AHC60974

SEQ ID NO: 85198 - RNA, 1410 nt, Artificial Sequence; identical to SEQ ID NO: 84979
  derived and/or modified sequence opt1 from neuraminidase__InfluenzaA__AHC60986

SEQ ID NO: 85199 - RNA, 1410 nt, Artificial Sequence; identical to SEQ ID NO: 85126
  derived and/or modified sequence opt1 from neuraminidase__InfluenzaA__AHC60998

SEQ ID NO: 85200 - RNA, 1410 nt, Artificial Sequence; identical to SEQ ID NO: 85026
  derived and/or modified sequence opt1 from neuraminidase__InfluenzaA__AHC61010

SEQ ID NO: 85201 - RNA, 1410 nt, Artificial Sequence
  derived and/or modified sequence opt1 from neuraminidase__InfluenzaA__AHC61022
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccaucagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcacguccgggaccuacggcaccgggagcuggccggacggcgccgaccugaaccucaugcccaucuga

SEQ ID NO: 85202 - RNA, 1410 nt, Artificial Sequence; identical to SEQ ID NO: 80526
  derived and/or modified sequence opt1 from neuraminidase__InfluenzaA__AHC61034

SEQ ID NO: 85203 - RNA, 1410 nt, Artificial Sequence; identical to SEQ ID NO: 84979
  derived and/or modified sequence opt1 from neuraminidase__InfluenzaA__AHC61046

SEQ ID NO: 85204 - RNA, 1410 nt, Artificial Sequence; identical to SEQ ID NO: 85028
  derived and/or modified sequence opt1 from neuraminidase__InfluenzaA__AHC61058

SEQ ID NO: 85205 - RNA, 1410 nt, Artificial Sequence; identical to SEQ ID NO: 84891
  derived and/or modified sequence opt1 from neuraminidase__InfluenzaA__AHC61070

SEQ ID NO: 85206 - RNA, 1410 nt, Artificial Sequence
  derived and/or modified sequence opt1 from neuraminidase__InfluenzaA__AHC61082
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccggcguccucuggaccagcaacuccaucgugguguucugcgggacgagcggcaccuacgggaccggcuccuggcccgacggggccgaccugaaccugaugcccaucuga

SEQ ID NO: 85207 - RNA, 1410 nt, Artificial Sequence; identical to SEQ ID NO: 80526
  derived and/or modified sequence opt1 from neuraminidase__InfluenzaA__AHC61094

SEQ ID NO: 85208 - RNA, 1410 nt, Artificial Sequence; identical to SEQ ID NO: 85015
  derived and/or modified sequence opt1 from neuraminidase__InfluenzaA__AHC61106

SEQ ID NO: 85209 - RNA, 1410 nt, Artificial Sequence; identical to SEQ ID NO: 85015
  derived and/or modified sequence opt1 from neuraminidase__InfluenzaA__AHC61118

SEQ ID NO: 85210 - RNA, 1410 nt, Artificial Sequence; identical to SEQ ID NO: 84979
  derived and/or modified sequence opt1 from neuraminidase__InfluenzaA__AHC61130

SEQ ID NO: 85211 - RNA, 1410 nt, Artificial Sequence; identical to SEQ ID NO: 85126
  derived and/or modified sequence opt1 from neuraminidase__InfluenzaA__AHC61142

SEQ ID NO: 85212 - RNA, 1410 nt, Artificial Sequence; identical to SEQ ID NO: 85015
  derived and/or modified sequence opt1 from neuraminidase__InfluenzaA__AHC61154

SEQ ID NO: 85213 - RNA, 1410 nt, Artificial Sequence
  derived and/or modified sequence opt1 from neuraminidase__InfluenzaA__AHC61166
augaaccccaaccagaagaucaucaccaucggcagcgugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccgucgugagcugguccaaggagauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccuggucggcgacacgccccgcaagaacgacuccagcuccagcucccacugccucgaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcugcagaccaaccgccaggugaucgucgaccggggcaaccgguccggguacagcggcaucuucuccguggagggcaagagcugcaucaaccgcugcuucuacguggagcucauccgggggcgcaaggaggagaccgagguccuguggacgagcaacuccaucgugguguucugcggcaccagcgggaccuacggcaccggguccuggccggacggcgccgaccugaaccucaugcccaucuga

SEQ ID NO: 85214 - RNA, 1410 nt, Artificial Sequence; identical to SEQ ID NO: 84979
  derived and/or modified sequence opt1 from neuraminidase__InfluenzaA__AHC61178

SEQ ID NO: 85215 - RNA, 1410 nt, Artificial Sequence; identical to SEQ ID NO: 85015
  derived and/or modified sequence opt1 from neuraminidase__InfluenzaA__AHC61190

SEQ ID NO: 85216 - RNA, 1410 nt, Artificial Sequence; identical to SEQ ID NO: 85028
  derived and/or modified sequence opt1 from neuraminidase__InfluenzaA__AHC61202

SEQ ID NO: 85217 - RNA, 1410 nt, Artificial Sequence; identical to SEQ ID NO: 84983
  derived and/or modified sequence opt1 from neuraminidase__InfluenzaA__AHC61214

SEQ ID NO: 85218 - RNA, 1410 nt, Artificial Sequence; identical to SEQ ID NO: 85028
  derived and/or modified sequence opt1 from neuraminidase__InfluenzaA__AHC61226

SEQ ID NO: 85219 - RNA, 1410 nt, Artificial Sequence; identical to SEQ ID NO: 85015
  derived and/or modified sequence opt1 from neuraminidase__InfluenzaA__AHC61238

SEQ ID NO: 85220 - RNA, 1410 nt, Artificial Sequence; identical to SEQ ID NO: 85196
  derived and/or modified sequence opt1 from neuraminidase__InfluenzaA__AHC61250

SEQ ID NO: 85221 - RNA, 1410 nt, Artificial Sequence; identical to SEQ ID NO: 84979
  derived and/or modified sequence opt1 from neuraminidase__InfluenzaA__AHC61262

SEQ ID NO: 85222 - RNA, 1410 nt, Artificial Sequence; identical to SEQ ID NO: 84983
  derived and/or modified sequence opt1 from neuraminidase__InfluenzaA__AHC61274

SEQ ID NO: 85223 - RNA, 1410 nt, Artificial Sequence; identical to SEQ ID NO: 80526
  derived and/or modified sequence opt1 from neuraminidase__InfluenzaA__AHC61286

SEQ ID NO: 85224 - RNA, 1410 nt, Artificial Sequence; identical to SEQ ID NO: 85027
  derived and/or modified sequence opt1 from neuraminidase__InfluenzaA__AHC61298

SEQ ID NO: 85225 - RNA, 1410 nt, Artificial Sequence
  derived and/or modified sequence opt1 from neuraminidase__InfluenzaA__AHC61310
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucaucgaccggggcaaccgguccggguacagcggcaucuucuccguggagggcaagagcugcaucaaccgcugcuucuacgucgagcucauccgggggcgcaaggaggagaccgaggugcuguggaccagcuccagcaucguggucuucugcggcacguccgggaccuacggcaccgggagcuggccggacggcgccgaccugaaccucaugcccaucuga

SEQ ID NO: 85226 - RNA, 1410 nt, Artificial Sequence; identical to SEQ ID NO: 85056
  derived and/or modified sequence opt1 from neuraminidase__InfluenzaA__AHC61322

SEQ ID NO: 85227 - RNA, 1410 nt, Artificial Sequence; identical to SEQ ID NO: 85015
  derived and/or modified sequence opt1 from neuraminidase__InfluenzaA__AHC61334

SEQ ID NO: 85228 - RNA, 1410 nt, Artificial Sequence; identical to SEQ ID NO: 84983
  derived and/or modified sequence opt1 from neuraminidase__InfluenzaA__AHC61346

SEQ ID NO: 85229 - RNA, 1410 nt, Artificial Sequence
  derived and/or modified sequence opt1 from neuraminidase__InfluenzaA__AHC61358
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacaucuccagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucaagggguggagcaaccccaaguccaagcugcagaucaaccgccaggugaucguggaccggggcaaccgcagcggguacuccggcaucuucagcgucgaggggaaguccugcaucaaccggugcuucuacguggagcucauccgcggccggaaggaggagaccgaggugcuguggaccagcaacagcaucgucguguucugcggcacguccgggaccuacggcaccgggagcuggccggacggcgccgaccugaaccucaugcccaucuga

SEQ ID NO: 85230 - RNA, 1410 nt, Artificial Sequence; identical to SEQ ID NO: 85028
  derived and/or modified sequence opt1 from neuraminidase__InfluenzaA__AHC61370

SEQ ID NO: 85231 - RNA, 1410 nt, Artificial Sequence; identical to SEQ ID NO: 85056
  derived and/or modified sequence opt1 from neuraminidase__InfluenzaA__AHC61382

SEQ ID NO: 85232 - RNA, 1410 nt, Artificial Sequence; identical to SEQ ID NO: 85028
  derived and/or modified sequence opt1 from neuraminidase__InfluenzaA__AHC61394

SEQ ID NO: 85233 - RNA, 1410 nt, Artificial Sequence; identical to SEQ ID NO: 85056
  derived and/or modified sequence opt1 from neuraminidase__InfluenzaA__AHC61406

SEQ ID NO: 85234 - RNA, 1410 nt, Artificial Sequence; identical to SEQ ID NO: 85015
  derived and/or modified sequence opt1 from neuraminidase__InfluenzaA__AHC61418

SEQ ID NO: 85235 - RNA, 1410 nt, Artificial Sequence; identical to SEQ ID NO: 80526
  derived and/or modified sequence opt1 from neuraminidase__InfluenzaA__AHC61430

SEQ ID NO: 85236 - RNA, 1410 nt, Artificial Sequence; identical to SEQ ID NO: 85028
  derived and/or modified sequence opt1 from neuraminidase__InfluenzaA__AHC61442

SEQ ID NO: 85237 - RNA, 1410 nt, Artificial Sequence; identical to SEQ ID NO: 85028
  derived and/or modified sequence opt1 from neuraminidase__InfluenzaA__AHC61454

SEQ ID NO: 85238 - RNA, 1410 nt, Artificial Sequence
  derived and/or modified sequence opt1 from neuraminidase__InfluenzaA__AHC61466
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaccaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggacaagggcaaccgguccggguacagcggcaucuucuccgucgagggcaagagcugcaucaaccgcugcuucuacguggagcucauccgggggcgcaaggaggagaccgaggugcuguggacgagcaacuccaucgucguguucugcggcaccagcgggaccuacggcaccggguccuggccggacggcgccgaccugaaccucaugcccaucuga

SEQ ID NO: 85239 - RNA, 1410 nt, Artificial Sequence; identical to SEQ ID NO: 84979
  derived and/or modified sequence opt1 from neuraminidase__InfluenzaA__AHC61478

SEQ ID NO: 85240 - RNA, 1410 nt, Artificial Sequence; identical to SEQ ID NO: 85015
  derived and/or modified sequence opt1 from neuraminidase__InfluenzaA__AHC61490

SEQ ID NO: 85241 - RNA, 1410 nt, Artificial Sequence; identical to SEQ ID NO: 84979
  derived and/or modified sequence opt1 from neuraminidase__InfluenzaA__AHC61502

SEQ ID NO: 85242 - RNA, 1410 nt, Artificial Sequence; identical to SEQ ID NO: 85028
  derived and/or modified sequence opt1 from neuraminidase__InfluenzaA__AHC61514

SEQ ID NO: 85243 - RNA, 1410 nt, Artificial Sequence; identical to SEQ ID NO: 83930
  derived and/or modified sequence opt1 from neuraminidase__InfluenzaA__AHC61526

SEQ ID NO: 85244 - RNA, 1410 nt, Artificial Sequence
  derived and/or modified sequence opt1 from neuraminidase__InfluenzaA__AHC61538
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggaggggagccacggcgucaaggggugggccuucgacgacggcaacgacguguggauggggcggaccaucaacgagaccucccgccugggcuacgagaccuucaaggucaucgagggcuggagcaaccccaaguccaagcugcagaucaaccgccaggugaucguggaccgggggaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcacguccggcaccuacgggaccggcagcuggccggacggggccgaccugaaccucaugcccaucuga

SEQ ID NO: 85245 - RNA, 1410 nt, Artificial Sequence; identical to SEQ ID NO: 85028
  derived and/or modified sequence opt1 from neuraminidase__InfluenzaA__AHC61550

SEQ ID NO: 85246 - RNA, 1410 nt, Artificial Sequence
  derived and/or modified sequence opt1 from neuraminidase__InfluenzaA__AHC61562
augaaccccaaccagaagaucaucaccaucggcagcgugucccugaccaucagcacgaucugcuucuucaugcagaucgccauccucaucaccaccgucacccugcacuucaagcaguacgaguucuacuccccgcccaacaaccaggugaugcugugcgagcccacgaugaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagagcaagagcugcaucaaccggugcuucuacguggagcucauccgcgggcggaaggaggagaccgaggugcuguggaccuccaacagcaucgucguguucugcggcacguccggcaccuacgggaccggcaccuggccggacggggccgaccugaaccucaugcccaucuga

SEQ ID NO: 85247 - RNA, 1410 nt, Artificial Sequence; identical to SEQ ID NO: 85027
  derived and/or modified sequence opt1 from neuraminidase__InfluenzaA__AHC61574

SEQ ID NO: 85248 - RNA, 1410 nt, Artificial Sequence; identical to SEQ ID NO: 85028
  derived and/or modified sequence opt1 from neuraminidase__InfluenzaA__AHC61586

SEQ ID NO: 85249 - RNA, 1410 nt, Artificial Sequence; identical to SEQ ID NO: 83930
  derived and/or modified sequence opt1 from neuraminidase__InfluenzaA__AHC61598

SEQ ID NO: 85250 - RNA, 1410 nt, Artificial Sequence; identical to SEQ ID NO: 84979
  derived and/or modified sequence opt1 from neuraminidase__InfluenzaA__AHC61610

SEQ ID NO: 85251 - RNA, 1410 nt, Artificial Sequence; identical to SEQ ID NO: 85027
  derived and/or modified sequence opt1 from neuraminidase__InfluenzaA__AHC61622

SEQ ID NO: 85252 - RNA, 1410 nt, Artificial Sequence; identical to SEQ ID NO: 80526
  derived and/or modified sequence opt1 from neuraminidase__InfluenzaA__AHC61634

SEQ ID NO: 85253 - RNA, 1410 nt, Artificial Sequence; identical to SEQ ID NO: 80526
  derived and/or modified sequence opt1 from neuraminidase__InfluenzaA__AHC61646

SEQ ID NO: 85254 - RNA, 1410 nt, Artificial Sequence; identical to SEQ ID NO: 80526
  derived and/or modified sequence opt1 from neuraminidase__InfluenzaA__AHC61658

SEQ ID NO: 85255 - RNA, 1410 nt, Artificial Sequence; identical to SEQ ID NO: 83930
  derived and/or modified sequence opt1 from neuraminidase__InfluenzaA__AHC61670

SEQ ID NO: 85256 - RNA, 1410 nt, Artificial Sequence; identical to SEQ ID NO: 84983
  derived and/or modified sequence opt1 from neuraminidase__InfluenzaA__AHC61682

SEQ ID NO: 85257 - RNA, 1410 nt, Artificial Sequence; identical to SEQ ID NO: 83930
  derived and/or modified sequence opt1 from neuraminidase__InfluenzaA__AHC61694

SEQ ID NO: 85258 - RNA, 1410 nt, Artificial Sequence
  derived and/or modified sequence opt1 from neuraminidase__InfluenzaA__AHC61706
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggagcacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85259 - RNA, 1410 nt, Artificial Sequence
  derived and/or modified sequence opt1 from neuraminidase__InfluenzaA__AHC61718
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcugaccgaguaccggaacuggagcaagccgcagugcgacaucaccggguucgcccccuucuccaaggacaacagcauccgccuguccgcgggcggggacaucugggucacccgggagcccuacgugagcugcgaccccaacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgccaccgcgagcuucaucuacaacgggaagcugguggacuccguggucagcugguccaaggagauccugcggacgcaggagagcgagugcgugugcaucaacgggaccugcaccguggucaugaccgacggguccgccagcggcaaggccgacacgaagauccucuucaucgaggagggcaagaucgugcacaccagcacccuguccgggagcgcccagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcggccacggggucaagggcugggcguucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccggcgugcuguggacgagcaacuccaucgucguguucugcgggaccagcggcaccuacgggaccggcuccuggccggacggggccgaccugaaccucaugcccaucuga

SEQ ID NO: 85260 - RNA, 1410 nt, Artificial Sequence; identical to SEQ ID NO: 84979
  derived and/or modified sequence opt1 from neuraminidase__InfluenzaA__AHC61730

SEQ ID NO: 85261 - RNA, 1410 nt, Artificial Sequence; identical to SEQ ID NO: 85028
  derived and/or modified sequence opt1 from neuraminidase__InfluenzaA__AHC61742

SEQ ID NO: 85262 - RNA, 1410 nt, Artificial Sequence; identical to SEQ ID NO: 84979
  derived and/or modified sequence opt1 from neuraminidase__InfluenzaA__AHC61754

SEQ ID NO: 85263 - RNA, 1410 nt, Artificial Sequence; identical to SEQ ID NO: 80526
  derived and/or modified sequence opt1 from neuraminidase__InfluenzaA__AHC61766

SEQ ID NO: 85264 - RNA, 1410 nt, Artificial Sequence; identical to SEQ ID NO: 85015
  derived and/or modified sequence opt1 from neuraminidase__InfluenzaA__AHC61778

SEQ ID NO: 85265 - RNA, 1410 nt, Artificial Sequence; identical to SEQ ID NO: 85053
  derived and/or modified sequence opt1 from neuraminidase__InfluenzaA__AHC61790

SEQ ID NO: 85266 - RNA, 1410 nt, Artificial Sequence; identical to SEQ ID NO: 84983
  derived and/or modified sequence opt1 from neuraminidase__InfluenzaA__AHC61802

SEQ ID NO: 85267 - RNA, 1410 nt, Artificial Sequence; identical to SEQ ID NO: 84979
  derived and/or modified sequence opt1 from neuraminidase__InfluenzaA__AHC61814

SEQ ID NO: 85268 - RNA, 1410 nt, Artificial Sequence
  derived and/or modified sequence opt1 from neuraminidase__InfluenzaA__AHC61826
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccgguccgaccgcagcggcuacuccgggaucuucagcguggagggcaagagcugcaucaaccggugcuucuacguggagcugauccgcgggcggaaggaggagaccgagguccucuggaccuccaacagcaucgugguguucugcggcacguccggcaccuacgggaccggcagcuggcccgacggggccgaccugaaccugaugcccaucuga

SEQ ID NO: 85269 - RNA, 1410 nt, Artificial Sequence; identical to SEQ ID NO: 84979
  derived and/or modified sequence opt1 from neuraminidase__InfluenzaA__AHC61838

SEQ ID NO: 85270 - RNA, 1410 nt, Artificial Sequence; identical to SEQ ID NO: 85015
  derived and/or modified sequence opt1 from neuraminidase__InfluenzaA__AHC61850

SEQ ID NO: 85271 - RNA, 1410 nt, Artificial Sequence; identical to SEQ ID NO: 85028
  derived and/or modified sequence opt1 from neuraminidase__InfluenzaA__AHC61862

SEQ ID NO: 85272 - RNA, 1410 nt, Artificial Sequence; identical to SEQ ID NO: 84979
  derived and/or modified sequence opt1 from neuraminidase__InfluenzaA__AHC61874

SEQ ID NO: 85273 - RNA, 1410 nt, Artificial Sequence
  derived and/or modified sequence opt1 from neuraminidase__InfluenzaA__AHC61886
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccagguggugcugugcgagcccacgaucaucgagcgcaacaucaccgagaucgucuaccucaccaacaccacgaucgagaaggagaucugccccaagcccgccgaguaccggcacugguccaagccccagugcgacaucaccggguucgcgcccuucagcaaggacaacuccauccgccugagcgccggcggggacaucugggugacccgggagccguacguguccugcgaccccgacaagugcuaccaguucgcccugggccaggggaccacgcucaacaacguccacagcaacaacaccgugcgcgaccggacccccuaccgcacccugcugaugaacgagcucggcgugcccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcgucguguccuggagcaaggagauccugcgcacccaggaguccgagugcgugugcaucaacggcacgugcaccgucgugaugaccgacgggagcgccuccggcaaggccgacaccaagauccuguucaucgaggagggcaagaucgugcacacgagcacccucagcggguccgcgcagcacgucgaggagugcagcugcuacccgcgguaccccggcgugcgcugcgugugccgggacaacuggaagggguccaaccgccccaucgucgacaucaacaucaaggaccacagcaucguguccagcuacgugugcuccggccuggucggcgacacgccccggaagaacgacagcuccagcuccagccacugccuggacccgaacaacgaggagggcgggcacggggugaagggcugggccuucgacgacgggaacgacgucuggaugggccgcaccaucaacgagaccucccggcucggcuacgagaccuucaaggugaucgagggguggagcaaccccaaguccaagcugcagaucaaccgccaggugaucgucgaccggggcgaccgcagcggguacuccggcaucuucagcguggaggggaaguccugcaucaaccggugcuucuacguggagcugauccgcggccggaaggaggagaccgagguccucuggaccagcaacagcaucgugguguucugcggcacguccgggaccuacggcaccgggagcuggcccgacggcgccgaccugaaccugaugcccaucuga

SEQ ID NO: 85274 - RNA, 1410 nt, Artificial Sequence; identical to SEQ ID NO: 84983
  derived and/or modified sequence opt1 from neuraminidase__InfluenzaA__AHC61898

SEQ ID NO: 85275 - RNA, 1410 nt, Artificial Sequence; identical to SEQ ID NO: 85015
  derived and/or modified sequence opt1 from neuraminidase__InfluenzaA__AHC61910

SEQ ID NO: 85276 - RNA, 1410 nt, Artificial Sequence; identical to SEQ ID NO: 80526
  derived and/or modified sequence opt1 from neuraminidase__InfluenzaA__AHC61934

SEQ ID NO: 85277 - RNA, 1410 nt, Artificial Sequence
  derived and/or modified sequence opt1 from neuraminidase__InfluenzaA__AHC61946
augaaccccaaccagaagaucaucaccaucggcagcgugucccugaccaucagcacgaucugcuucuucaugcagaucgccauccucaucaccaccgucacccugcacuucaagcaguacgaguccuacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccggaaccccggcguccgcugcgugugccgggacaacuggaagggguccaaccgcccgaucguggacaucaacaucaaggaccacagcaucgucuccagcuacgugugcuccggccuggugggcgacacgccccggaagaacgacagcuccagcuccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggccggacggcgccgaccugaaccucaugcccaucuga

SEQ ID NO: 85278 - RNA, 1410 nt, Artificial Sequence; identical to SEQ ID NO: 83930
  derived and/or modified sequence opt1 from neuraminidase__InfluenzaA__AHC61958

SEQ ID NO: 85279 - RNA, 1410 nt, Artificial Sequence; identical to SEQ ID NO: 84979
  derived and/or modified sequence opt1 from neuraminidase__InfluenzaA__AHC61970

SEQ ID NO: 85280 - RNA, 1410 nt, Artificial Sequence
  derived and/or modified sequence opt1 from neuraminidase__InfluenzaA__AHC61982
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcgccguggucaugaccgacggguccgccagcggcaaggcggacaccaagauccucuucaucgaggagggcaagaucgugcacaccagcacgcuguccgggagcgcccagcacguggaggagugcuccugcuacccccgguaccccggcguccgcugcgugugccgggacaacuggaaggggagcaaccgcccgaucguggacaucaacaucaaggaccacggcaucgucuccagcuacgugugcuccggccuggugggggacacgccccggaagaacgacagcuccagcuccagccacugccucgaccccaacaacgaggagggcgggcacggcgucaaggggugggccuucgacgacggcaacgacguguggaugggccgcaccaucaacgagaccucccggcugggguacgagaccuucaaggucaucgagggcuggagcaaccccaaguccaagcugcagaucaaccgccaggugaucguggaccgggggaaccgcagcggcuacuccgggaucuucagcgucgagggcaaguccugcaucaaccggugcuucuacguggagcucauccgcggccggaaggaggagaccgaggugcuguggaccagcaacagcaucgucguguucugcgggaccuccggcacguacgggaccggcagcuggccggacggggccgaccugaaccucaugcccaucuga

SEQ ID NO: 85281 - RNA, 1410 nt, Artificial Sequence; identical to SEQ ID NO: 84983
  derived and/or modified sequence opt1 from neuraminidase__InfluenzaA__AHC61994

SEQ ID NO: 85282 - RNA, 1410 nt, Artificial Sequence; identical to SEQ ID NO: 85015
  derived and/or modified sequence opt1 from neuraminidase__InfluenzaA__AHC62006

SEQ ID NO: 85283 - RNA, 1410 nt, Artificial Sequence; identical to SEQ ID NO: 84979
  derived and/or modified sequence opt1 from neuraminidase__InfluenzaA__AHC62018

SEQ ID NO: 85284 - RNA, 1410 nt, Artificial Sequence; identical to SEQ ID NO: 83930
  derived and/or modified sequence opt1 from neuraminidase__InfluenzaA__AHC62030

SEQ ID NO: 85285 - RNA, 1410 nt, Artificial Sequence; identical to SEQ ID NO: 84983
  derived and/or modified sequence opt1 from neuraminidase__InfluenzaA__AHC62042

SEQ ID NO: 85286 - RNA, 1410 nt, Artificial Sequence; identical to SEQ ID NO: 85056
  derived and/or modified sequence opt1 from neuraminidase__InfluenzaA__AHC62053

SEQ ID NO: 85287 - RNA, 1410 nt, Artificial Sequence
  derived and/or modified sequence opt1 from neuraminidase__InfluenzaA__AHC62065
augaaccccaaccagaagaucaucaccaucggcagcgugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 85288 - RNA, 1410 nt, Artificial Sequence; identical to SEQ ID NO: 85114
  derived and/or modified sequence opt1 from neuraminidase__InfluenzaA__AHC62077

SEQ ID NO: 85289 - RNA, 1410 nt, Artificial Sequence; identical to SEQ ID NO: 85028
  derived and/or modified sequence opt1 from neuraminidase__InfluenzaA__AHC62089

SEQ ID NO: 85290 - RNA, 1410 nt, Artificial Sequence; identical to SEQ ID NO: 84979
  derived and/or modified sequence opt1 from neuraminidase__InfluenzaA__AHC62101

SEQ ID NO: 85291 - RNA, 1410 nt, Artificial Sequence; identical to SEQ ID NO: 85028
  derived and/or modified sequence opt1 from neuraminidase__InfluenzaA__AHC62113

SEQ ID NO: 85292 - RNA, 1410 nt, Artificial Sequence
  derived and/or modified sequence opt1 from neuraminidase__InfluenzaA__AHC62125
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaacaaguccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85293 - RNA, 1410 nt, Artificial Sequence
  derived and/or modified sequence opt1 from neuraminidase__InfluenzaA__AHC62137
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85294 - RNA, 1410 nt, Artificial Sequence
  derived and/or modified sequence opt1 from neuraminidase__InfluenzaA__AHC62149
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacauccgggaccacuccaucgucagcuccuacgugugcagcggccuggugggcgacaccccgcgcaagaacgacuccagcuccagcucccacugccuggaccccaacaacgaggagggcgggcacggggucaagggcugggccuucgacgacgggaacgacguguggaugggccggaccaucaacgagacgagccgccucggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85295 - RNA, 1410 nt, Artificial Sequence; identical to SEQ ID NO: 85015
  derived and/or modified sequence opt1 from neuraminidase__InfluenzaA__AHC62161

SEQ ID NO: 85296 - RNA, 1410 nt, Artificial Sequence
  derived and/or modified sequence opt1 from neuraminidase__InfluenzaA__AHC62173
augaaccccaaccagaagaucaucaccaucggcagcgugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 85297 - RNA, 1410 nt, Artificial Sequence; identical to SEQ ID NO: 85028
  derived and/or modified sequence opt1 from neuraminidase__InfluenzaA__AHC62185

SEQ ID NO: 85298 - RNA, 1410 nt, Artificial Sequence; identical to SEQ ID NO: 83930
  derived and/or modified sequence opt1 from neuraminidase__InfluenzaA__AHC62197

SEQ ID NO: 85299 - RNA, 1410 nt, Artificial Sequence
  derived and/or modified sequence opt1 from neuraminidase__InfluenzaA__AHC62209
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaagaaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85300 - RNA, 1410 nt, Artificial Sequence; identical to SEQ ID NO: 84983
  derived and/or modified sequence opt1 from neuraminidase__InfluenzaA__AHC62221

SEQ ID NO: 85301 - RNA, 1410 nt, Artificial Sequence; identical to SEQ ID NO: 80526
  derived and/or modified sequence opt1 from neuraminidase__InfluenzaA__AHC62233

SEQ ID NO: 85302 - RNA, 1410 nt, Artificial Sequence; identical to SEQ ID NO: 84979
  derived and/or modified sequence opt1 from neuraminidase__InfluenzaA__AHC62245

SEQ ID NO: 85303 - RNA, 1410 nt, Artificial Sequence
  derived and/or modified sequence opt1 from neuraminidase__InfluenzaA__AHC62257
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgugggccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85304 - RNA, 1410 nt, Artificial Sequence; identical to SEQ ID NO: 85056
  derived and/or modified sequence opt1 from neuraminidase__InfluenzaA__AHC62269

SEQ ID NO: 85305 - RNA, 1410 nt, Artificial Sequence; identical to SEQ ID NO: 85028
  derived and/or modified sequence opt1 from neuraminidase__InfluenzaA__AHC62281

SEQ ID NO: 85306 - RNA, 1410 nt, Artificial Sequence; identical to SEQ ID NO: 84983
  derived and/or modified sequence opt1 from neuraminidase__InfluenzaA__AHC62293

SEQ ID NO: 85307 - RNA, 1410 nt, Artificial Sequence; identical to SEQ ID NO: 80526
  derived and/or modified sequence opt1 from neuraminidase__InfluenzaA__AHC62305

SEQ ID NO: 85308 - RNA, 1410 nt, Artificial Sequence; identical to SEQ ID NO: 84979
  derived and/or modified sequence opt1 from neuraminidase__InfluenzaA__AHC62317

SEQ ID NO: 85309 - RNA, 1410 nt, Artificial Sequence
  derived and/or modified sequence opt1 from neuraminidase__InfluenzaA__AHC62329
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagcuccuacgugugcagcggccuggugggcgacaccccgcggaagaacgacuccagcuccagcucccacugccuggaccccaacaacgaggagggcgggcacggggucaagggcugggccuucgacgacgggaacgacguguggaugggccgcaccaucaacgagacgagccggcucggcuacgagaccuucaaggucaucgaggggugguccaaccccaagagcaagcugcagaucaaccgccaggugaucgccgaccggggcgaccgcuccggguacagcggcaucuucuccguggagggcaagagcugcaucaaccggugcuucuacgucgagcugauccgcgggcggaaggaggagaccgaggugcucuggaccagcaacuccaucguggucuucugcggcacgagcgggaccuacggcaccggguccuggcccgacggcgccgaccugaaccugaugcccaucuga

SEQ ID NO: 85310 - RNA, 1410 nt, Artificial Sequence; identical to SEQ ID NO: 84979
  derived and/or modified sequence opt1 from neuraminidase__InfluenzaA__AHC62341

SEQ ID NO: 85311 - RNA, 1410 nt, Artificial Sequence
  derived and/or modified sequence opt1 from neuraminidase__InfluenzaA__AHC62353
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaccgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggacgagcaacuccaucgucguguucugcggcaccagcgggaccuacggcaccggguccuggccggacggcgccgaccugaaccucaugcccaucuga

SEQ ID NO: 85312 - RNA, 1410 nt, Artificial Sequence; identical to SEQ ID NO: 84979
  derived and/or modified sequence opt1 from neuraminidase__InfluenzaA__AHC62365

SEQ ID NO: 85313 - RNA, 1410 nt, Artificial Sequence; identical to SEQ ID NO: 85196
  derived and/or modified sequence opt1 from neuraminidase__InfluenzaA__AHC62377

SEQ ID NO: 85314 - RNA, 1410 nt, Artificial Sequence; identical to SEQ ID NO: 85028
  derived and/or modified sequence opt1 from neuraminidase__InfluenzaA__AHC62389

SEQ ID NO: 85315 - RNA, 1410 nt, Artificial Sequence; identical to SEQ ID NO: 85028
  derived and/or modified sequence opt1 from neuraminidase__InfluenzaA__AHC62401

SEQ ID NO: 85316 - RNA, 1410 nt, Artificial Sequence; identical to SEQ ID NO: 85056
  derived and/or modified sequence opt1 from neuraminidase__InfluenzaA__AHC62413

SEQ ID NO: 85317 - RNA, 1410 nt, Artificial Sequence; identical to SEQ ID NO: 85114
  derived and/or modified sequence opt1 from neuraminidase__InfluenzaA__AHC62425

SEQ ID NO: 85318 - RNA, 1410 nt, Artificial Sequence; identical to SEQ ID NO: 80526
  derived and/or modified sequence opt1 from neuraminidase__InfluenzaA__AHC62437

SEQ ID NO: 85319 - RNA, 1410 nt, Artificial Sequence; identical to SEQ ID NO: 85028
  derived and/or modified sequence opt1 from neuraminidase__InfluenzaA__AHC62449

SEQ ID NO: 85320 - RNA, 1410 nt, Artificial Sequence; identical to SEQ ID NO: 84983
  derived and/or modified sequence opt1 from neuraminidase__InfluenzaA__AHC62461

SEQ ID NO: 85321 - RNA, 1410 nt, Artificial Sequence; identical to SEQ ID NO: 84979
  derived and/or modified sequence opt1 from neuraminidase__InfluenzaA__AHC62473

SEQ ID NO: 85322 - RNA, 1410 nt, Artificial Sequence; identical to SEQ ID NO: 83154
  derived and/or modified sequence opt1 from neuraminidase__InfluenzaA__AHC62485

SEQ ID NO: 85323 - RNA, 1410 nt, Artificial Sequence; identical to SEQ ID NO: 85028
  derived and/or modified sequence opt1 from neuraminidase__InfluenzaA__AHC62509

SEQ ID NO: 85324 - RNA, 1410 nt, Artificial Sequence
  derived and/or modified sequence opt1 from neuraminidase__InfluenzaA__AHC62521
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucaacgagaccagccgccugggcuacgagaccuucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcucauccgggggcgcaaggaggagaccgaggugcuguggaccagcaacuccaucaucgucuucugcggcacgagcgggaccuacggcaccggguccuggccggacggcgccgaccugaaccucaugcccaucuga

SEQ ID NO: 85325 - RNA, 1410 nt, Artificial Sequence
  derived and/or modified sequence opt1 from neuraminidase__InfluenzaA__AHC62533
augaaccccaaccagaagaucaucaccaucggcagcgugucccugaccaucagcacgaucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggaagcugguggacuccguggucagcugguccaaggagauccuccggacccaggagagcgagugcgugugcaucaacggcacgugcaccguggucaugaccgacggguccgccagcggcaaggccgacaccaagauccuguucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccucgugggcgacacgccccgcaagaacgacuccagcuccagcucccacugccuggaccccaacaacgaggagggcgggaacggggucaagggcugggccuucgacgacgggaacgacguguggaugggccggaccaucaacgagaccagccgccugggcuacgagaccuucaaggucaucgaggggugguccaaccccaagagcaagcuccagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgaccucaaccugaugcccaucuga

SEQ ID NO: 85326 - RNA, 1410 nt, Artificial Sequence; identical to SEQ ID NO: 85183
  derived and/or modified sequence opt1 from neuraminidase__InfluenzaA__AHC62545

SEQ ID NO: 85327 - RNA, 1410 nt, Artificial Sequence; identical to SEQ ID NO: 85028
  derived and/or modified sequence opt1 from neuraminidase__InfluenzaA__AHC62557

SEQ ID NO: 85328 - RNA, 1410 nt, Artificial Sequence; identical to SEQ ID NO: 84979
  derived and/or modified sequence opt1 from neuraminidase__InfluenzaA__AHC62569

SEQ ID NO: 85329 - RNA, 1410 nt, Artificial Sequence; identical to SEQ ID NO: 85028
  derived and/or modified sequence opt1 from neuraminidase__InfluenzaA__AHC62581

SEQ ID NO: 85330 - RNA, 1410 nt, Artificial Sequence
  derived and/or modified sequence opt1 from neuraminidase__InfluenzaA__AHC62593
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcgggaacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85331 - RNA, 1410 nt, Artificial Sequence; identical to SEQ ID NO: 85015
  derived and/or modified sequence opt1 from neuraminidase__InfluenzaA__AHC62605

SEQ ID NO: 85332 - RNA, 1410 nt, Artificial Sequence
  derived and/or modified sequence opt1 from neuraminidase__InfluenzaA__AHC62617
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcgcugcgagcccacgaucaucgagcggaacaucaccgagaucguguaccugaccaacaccacgaucgagaaggagaucugccccaagcucgccgaguaccgcaacuggagcaagccgcagugcgacaucaccggguucgcgcccuucuccaaggacaacagcauccggcuguccgccggcggggacaucugggucacccgcgagcccuacgugagcugcgaccccaacaagugcuaccaguucgcccugggccaggggaccacgcucaacaacgugcacuccaacaacaccguccgggaccgcaccccguaccggacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggaagcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccuggaccccaacaacgaggagggcgggcacggggucaagggcugggccuucgacgacgggaacgacguguggaugggccgcaccaucaacgagaccagccggcucggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggccggacggcgccgaccugaaccugaugcccaucuga

SEQ ID NO: 85333 - RNA, 1410 nt, Artificial Sequence; identical to SEQ ID NO: 84983
  derived and/or modified sequence opt1 from neuraminidase__InfluenzaA__AHC62629

SEQ ID NO: 85334 - RNA, 1410 nt, Artificial Sequence
  derived and/or modified sequence opt1 from neuraminidase__InfluenzaA__AHC62641
augaaccccaaccagaagaucaucaccaucggcagcgugucccugaccaucagcacggucugcuucuucaugcaggucgccauccucaucaccaccgugacccugcacuucaagcaguacgaguucaacuccccgcccaacaaccaggugaugcugugcgagcccacgaucaucgagcgcaacaucaccgagauccucuaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggugacccgggagcccuacgugagcugcgaccccgacaagugcuaccaguucgcccugggccaggggaccacgcugaacaacguccacuccaacaacaccgugcgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggaagcugguggacuccgucgugagcugguccaaggagauccuccggacccaggagagcgagugcgugugcaucaacggcacgugcaccgucgugaugaccgacggguccgccagcggcaaggccgacaccaagauccuguucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucaacaucaaggaccacuccaucgugagcuccuacgugugcagcggccucgucggcgacacgccccgcaagaacgacuccagcuccagcucccacugccuggaccccaacaacgaggagggcgggcacggggugaagggcugggccuucgacgacgggaacgacgucuggaugggccggaccaucaacgagaccagccgccugggcuacgagaccuucaaggugaucgaggggugguccaaccccaagagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgaccucaaccugaugcccaucuga

SEQ ID NO: 85335 - RNA, 1410 nt, Artificial Sequence; identical to SEQ ID NO: 84983
  derived and/or modified sequence opt1 from neuraminidase__InfluenzaA__AHC62653

SEQ ID NO: 85336 - RNA, 1410 nt, Artificial Sequence; identical to SEQ ID NO: 84983
  derived and/or modified sequence opt1 from neuraminidase__InfluenzaA__AHC62665

SEQ ID NO: 85337 - RNA, 1410 nt, Artificial Sequence
  derived and/or modified sequence opt1 from neuraminidase__InfluenzaA__AHC62677
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggaagcugguggacuccguggucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggaccacuccaucgucagcuccuacgugugcagcggccuggugggcgacacgccccgcaagaacgacaucuccagcuccagccacugccucgaccccaacaacgaggagggcgggcacggggucaagggcugggccuucgacgacgggaacgacguguggaugggccggaccaucaacgagaccucccgccugggcuacgagaccuucaaggucaucgagggguggagcaaccccaaguccaagcugcagaucaaccgccaggugaucguggaccggggcaaccggagcggguacuccggcaucuucagcgucgaggggaaguccugcaucaaccgcugcuucuacguggagcucauccggggccgcaaggaggagaccgaggugcuguggaccagcaacagcaucgucguguucugcggcacguccgggaccuacggcaccgggagcuggccggacggcgccgaccugaaccucaugcccaucuga

SEQ ID NO: 85338 - RNA, 1398 nt, Artificial Sequence
  derived and/or modified sequence opt1 from neuraminidase__InfluenzaA__AHF20560
augaaccccaaccagaagauccugugcaccagcgccaccgccaucaucaucggcgcgaucacggugcucaucgggaucgccaaccugggccugaacaucgggcuccaccugaagccgggcugcaacugcucccacagccagcccgagaccaccaacaccucccagacgaucaucaacaacuacuacaacgagaccaacaccaccaacauccagauggaggagcgcacgagccggaacuucaacaaccugaccaaggggcucugcaccaucaacuccuggcacaucuacggcaaggacaacgccguccgcaucggcgagagcuccgacgugcuggugacccgggagcccuacgucagcugcgaccccgacgagugccgcuucuacgcccugucccaggggacgaccauccggggcaagcacagcaacgggaccauccacgaccgcucccaguaccgggcccucaucagcuggccgcuguccagcccgcccaccguguacaacucccgcguggagugcaucggcuggagcuccacgagcugccacgacgggaagucccggaugagcaucugcaucagcggccccaacaacaacgcguccgccgucgugugguacaaccgccggcccguggccgagaucaacaccugggcccgcaacauccugcggacccaggagagcgagugcgucugccacaacggcgugugccccguggucuucaccgacggguccgcgacgggccccgccgacacccgcaucuacuacuucaaggaggggaagauccucaagugggagagccugaccggcaccgccaagcacaucgaggagugcuccugcuacggcgagcggacggggaucacgugcacgugccgcgacaacuggcagggcagcaaccggcccgugauccagaucgacccgguggccaugacccacaccucccaguacaucugcagccccguccugaccgacaacccccgccccaacgacccgaacaucgggaagugcaacgaccccuaccccggcaacaacaacaacggggugaagggcuucuccuaccucgacggcgccaacaccuggcuggggcggaccaucagcaccgcgucccgcagcggcuacgagaugcugaaggugcccaacgcccucaccgacgaccgguccaagccgauccaggggcagaccaucguccugaacgccgacuggagcggcuacuccgggagcuucauggacuacugggccgagggcgacugcuaccgcgccugcuucuacguggagcugauccgcggccggcccaaggaggacaaggugugguggaccuccaacagcaucgucuccaugugcagcagcacggaguuccucgagcaguggaacuggcccgacggggcgaagaucgaguacuuccuguga

SEQ ID NO: 85339 - RNA, 1398 nt, Artificial Sequence; identical to SEQ ID NO: 84462
  derived and/or modified sequence opt1 from neuraminidase__InfluenzaA__AHF20570

SEQ ID NO: 85340 - RNA, 1413 nt, Artificial Sequence; identical to SEQ ID NO: 77640
  derived and/or modified sequence opt1 from neuraminidase__InfluenzaA__AHG96111

SEQ ID NO: 85341 - RNA, 1413 nt, Artificial Sequence; identical to SEQ ID NO: 77640
  derived and/or modified sequence opt1 from neuraminidase__InfluenzaA__AHG96123

SEQ ID NO: 85342 - RNA, 1413 nt, Artificial Sequence; identical to SEQ ID NO: 77640
  derived and/or modified sequence opt1 from neuraminidase__InfluenzaA__AHG96135

SEQ ID NO: 85343 - RNA, 1413 nt, Artificial Sequence; identical to SEQ ID NO: 77640
  derived and/or modified sequence opt1 from neuraminidase__InfluenzaA__AHG96147

SEQ ID NO: 85344 - RNA, 1413 nt, Artificial Sequence; identical to SEQ ID NO: 77640
  derived and/or modified sequence opt1 from neuraminidase__InfluenzaA__AHG96159

SEQ ID NO: 85345 - RNA, 1413 nt, Artificial Sequence; identical to SEQ ID NO: 77640
  derived and/or modified sequence opt1 from neuraminidase__InfluenzaA__AHG96171

SEQ ID NO: 85346 - RNA, 1413 nt, Artificial Sequence; identical to SEQ ID NO: 77640
  derived and/or modified sequence opt1 from neuraminidase__InfluenzaA__AHG96183

SEQ ID NO: 85347 - RNA, 1413 nt, Artificial Sequence; identical to SEQ ID NO: 77640
  derived and/or modified sequence opt1 from neuraminidase__InfluenzaA__AHG96195

SEQ ID NO: 85348 - RNA, 1413 nt, Artificial Sequence; identical to SEQ ID NO: 77640
  derived and/or modified sequence opt1 from neuraminidase__InfluenzaA__AHG96207

SEQ ID NO: 85349 - RNA, 1413 nt, Artificial Sequence; identical to SEQ ID NO: 77640
  derived and/or modified sequence opt1 from neuraminidase__InfluenzaA__AHG96219

SEQ ID NO: 85350 - RNA, 1413 nt, Artificial Sequence; identical to SEQ ID NO: 77640
  derived and/or modified sequence opt1 from neuraminidase__InfluenzaA__AHG96231

SEQ ID NO: 85351 - RNA, 1413 nt, Artificial Sequence; identical to SEQ ID NO: 77640
  derived and/or modified sequence opt1 from neuraminidase__InfluenzaA__AHG96243

SEQ ID NO: 85352 - RNA, 1413 nt, Artificial Sequence; identical to SEQ ID NO: 77640
  derived and/or modified sequence opt1 from neuraminidase__InfluenzaA__AHG96255

SEQ ID NO: 85353 - RNA, 1413 nt, Artificial Sequence; identical to SEQ ID NO: 77640
  derived and/or modified sequence opt1 from neuraminidase__InfluenzaA__AHG96267

SEQ ID NO: 85354 - RNA, 1413 nt, Artificial Sequence; identical to SEQ ID NO: 77640
  derived and/or modified sequence opt1 from neuraminidase__InfluenzaA__AHG96279

SEQ ID NO: 85355 - RNA, 1413 nt, Artificial Sequence; identical to SEQ ID NO: 77640
  derived and/or modified sequence opt1 from neuraminidase__InfluenzaA__AHG96291

SEQ ID NO: 85356 - RNA, 1413 nt, Artificial Sequence; identical to SEQ ID NO: 77640
  derived and/or modified sequence opt1 from neuraminidase__InfluenzaA__AHG96303

SEQ ID NO: 85357 - RNA, 1410 nt, Artificial Sequence; identical to SEQ ID NO: 77464
  derived and/or modified sequence opt1 from neuraminidase__InfluenzaA__AHG96362

SEQ ID NO: 85358 - RNA, 1410 nt, Artificial Sequence; identical to SEQ ID NO: 77464
  derived and/or modified sequence opt1 from neuraminidase__InfluenzaA__AHG96374

SEQ ID NO: 85359 - RNA, 1410 nt, Artificial Sequence; identical to SEQ ID NO: 77464
  derived and/or modified sequence opt1 from neuraminidase__InfluenzaA__AHG96386

SEQ ID NO: 85360 - RNA, 1413 nt, Artificial Sequence; identical to SEQ ID NO: 77640
  derived and/or modified sequence opt1 from neuraminidase__InfluenzaA__AHG96398

SEQ ID NO: 85361 - RNA, 1410 nt, Artificial Sequence; identical to SEQ ID NO: 77464
  derived and/or modified sequence opt1 from neuraminidase__InfluenzaA__AHG96410

SEQ ID NO: 85362 - RNA, 1410 nt, Artificial Sequence; identical to SEQ ID NO: 77464
  derived and/or modified sequence opt1 from neuraminidase__InfluenzaA__AHG96422

SEQ ID NO: 85363 - RNA, 1410 nt, Artificial Sequence; identical to SEQ ID NO: 77464
  derived and/or modified sequence opt1 from neuraminidase__InfluenzaA__AHG96434

SEQ ID NO: 85364 - RNA, 1410 nt, Artificial Sequence; identical to SEQ ID NO: 77464
  derived and/or modified sequence opt1 from neuraminidase__InfluenzaA__AHG96446

SEQ ID NO: 85365 - RNA, 1410 nt, Artificial Sequence; identical to SEQ ID NO: 77464
  derived and/or modified sequence opt1 from neuraminidase__InfluenzaA__AHG96458

SEQ ID NO: 85366 - RNA, 1410 nt, Artificial Sequence; identical to SEQ ID NO: 77464
  derived and/or modified sequence opt1 from neuraminidase__InfluenzaA__AHG96470

SEQ ID NO: 85367 - RNA, 1410 nt, Artificial Sequence; identical to SEQ ID NO: 77464
  derived and/or modified sequence opt1 from neuraminidase__InfluenzaA__AHG96482

SEQ ID NO: 85368 - RNA, 1410 nt, Artificial Sequence; identical to SEQ ID NO: 77464
  derived and/or modified sequence opt1 from neuraminidase__InfluenzaA__AHG96494

SEQ ID NO: 85369 - RNA, 1410 nt, Artificial Sequence; identical to SEQ ID NO: 77464
  derived and/or modified sequence opt1 from neuraminidase__InfluenzaA__AHG96506

SEQ ID NO: 85370 - RNA, 1413 nt, Artificial Sequence; identical to SEQ ID NO: 77640
  derived and/or modified sequence opt1 from neuraminidase__InfluenzaA__AHG96518

SEQ ID NO: 85371 - RNA, 1413 nt, Artificial Sequence; identical to SEQ ID NO: 77640
  derived and/or modified sequence opt1 from neuraminidase__InfluenzaA__AHG96530

SEQ ID NO: 85372 - RNA, 1413 nt, Artificial Sequence; identical to SEQ ID NO: 77640
  derived and/or modified sequence opt1 from neuraminidase__InfluenzaA__AHG96542

SEQ ID NO: 85373 - RNA, 1413 nt, Artificial Sequence; identical to SEQ ID NO: 77640
  derived and/or modified sequence opt1 from neuraminidase__InfluenzaA__AHG96554

SEQ ID NO: 85374 - RNA, 1413 nt, Artificial Sequence; identical to SEQ ID NO: 77640
  derived and/or modified sequence opt1 from neuraminidase__InfluenzaA__AHG96566

SEQ ID NO: 85375 - RNA, 1413 nt, Artificial Sequence; identical to SEQ ID NO: 77640
  derived and/or modified sequence opt1 from neuraminidase__InfluenzaA__AHG96578

SEQ ID NO: 85376 - RNA, 1413 nt, Artificial Sequence; identical to SEQ ID NO: 77640
  derived and/or modified sequence opt1 from neuraminidase__InfluenzaA__AHG96590

SEQ ID NO: 85377 - RNA, 1413 nt, Artificial Sequence; identical to SEQ ID NO: 77640
  derived and/or modified sequence opt1 from neuraminidase__InfluenzaA__AHG96602

SEQ ID NO: 85378 - RNA, 1413 nt, Artificial Sequence; identical to SEQ ID NO: 77640
  derived and/or modified sequence opt1 from neuraminidase__InfluenzaA__AHG96614

SEQ ID NO: 85379 - RNA, 1413 nt, Artificial Sequence; identical to SEQ ID NO: 77640
  derived and/or modified sequence opt1 from neuraminidase__InfluenzaA__AHG96626

SEQ ID NO: 85380 - RNA, 1413 nt, Artificial Sequence; identical to SEQ ID NO: 77640
  derived and/or modified sequence opt1 from neuraminidase__InfluenzaA__AHG96638

SEQ ID NO: 85381 - RNA, 1413 nt, Artificial Sequence; identical to SEQ ID NO: 77640
  derived and/or modified sequence opt1 from neuraminidase__InfluenzaA__AHG96650

SEQ ID NO: 85382 - RNA, 1413 nt, Artificial Sequence; identical to SEQ ID NO: 77640
  derived and/or modified sequence opt1 from neuraminidase__InfluenzaA__AHG96662

SEQ ID NO: 85383 - RNA, 1413 nt, Artificial Sequence; identical to SEQ ID NO: 77640
  derived and/or modified sequence opt1 from neuraminidase__InfluenzaA__AHG96674

SEQ ID NO: 85384 - RNA, 1413 nt, Artificial Sequence; identical to SEQ ID NO: 77640
  derived and/or modified sequence opt1 from neuraminidase__InfluenzaA__AHG96686

SEQ ID NO: 85385 - RNA, 1410 nt, Artificial Sequence; identical to SEQ ID NO: 77464
  derived and/or modified sequence opt1 from neuraminidase__InfluenzaA__AHG96698

SEQ ID NO: 85386 - RNA, 1410 nt, Artificial Sequence; identical to SEQ ID NO: 77464
  derived and/or modified sequence opt1 from neuraminidase__InfluenzaA__AHG96710

SEQ ID NO: 85387 - RNA, 1410 nt, Artificial Sequence; identical to SEQ ID NO: 77464
  derived and/or modified sequence opt1 from neuraminidase__InfluenzaA__AHG96722

SEQ ID NO: 85388 - RNA, 1410 nt, Artificial Sequence; identical to SEQ ID NO: 77464
  derived and/or modified sequence opt1 from neuraminidase__InfluenzaA__AHG96734

SEQ ID NO: 85389 - RNA, 1410 nt, Artificial Sequence; identical to SEQ ID NO: 77464
  derived and/or modified sequence opt1 from neuraminidase__InfluenzaA__AHG96746

SEQ ID NO: 85390 - RNA, 1410 nt, Artificial Sequence; identical to SEQ ID NO: 77464
  derived and/or modified sequence opt1 from neuraminidase__InfluenzaA__AHG96758

SEQ ID NO: 85391 - RNA, 1410 nt, Artificial Sequence; identical to SEQ ID NO: 77464
  derived and/or modified sequence opt1 from neuraminidase__InfluenzaA__AHG96770

SEQ ID NO: 85392 - RNA, 1410 nt, Artificial Sequence; identical to SEQ ID NO: 77464
  derived and/or modified sequence opt1 from neuraminidase__InfluenzaA__AHG96782

SEQ ID NO: 85393 - RNA, 1410 nt, Artificial Sequence; identical to SEQ ID NO: 77464
  derived and/or modified sequence opt1 from neuraminidase__InfluenzaA__AHG96794

SEQ ID NO: 85394 - RNA, 1410 nt, Artificial Sequence; identical to SEQ ID NO: 77464
  derived and/or modified sequence opt1 from neuraminidase__InfluenzaA__AHG96806

SEQ ID NO: 85395 - RNA, 1410 nt, Artificial Sequence; identical to SEQ ID NO: 77464
  derived and/or modified sequence opt1 from neuraminidase__InfluenzaA__AHG96818

SEQ ID NO: 85396 - RNA, 1410 nt, Artificial Sequence; identical to SEQ ID NO: 77464
  derived and/or modified sequence opt1 from neuraminidase__InfluenzaA__AHG96830

SEQ ID NO: 85397 - RNA, 1410 nt, Artificial Sequence; identical to SEQ ID NO: 77464
  derived and/or modified sequence opt1 from neuraminidase__InfluenzaA__AHG96842

SEQ ID NO: 85398 - RNA, 1410 nt, Artificial Sequence; identical to SEQ ID NO: 77464
  derived and/or modified sequence opt1 from neuraminidase__InfluenzaA__AHG96854

SEQ ID NO: 85399 - RNA, 1410 nt, Artificial Sequence; identical to SEQ ID NO: 77464
  derived and/or modified sequence opt1 from neuraminidase__InfluenzaA__AHG96866

SEQ ID NO: 85400 - RNA, 1410 nt, Artificial Sequence; identical to SEQ ID NO: 77464
  derived and/or modified sequence opt1 from neuraminidase__InfluenzaA__AHG96878

SEQ ID NO: 85401 - RNA, 1410 nt, Artificial Sequence; identical to SEQ ID NO: 77464
  derived and/or modified sequence opt1 from neuraminidase__InfluenzaA__AHG96890

SEQ ID NO: 85402 - RNA, 1410 nt, Artificial Sequence; identical to SEQ ID NO: 77464
  derived and/or modified sequence opt1 from neuraminidase__InfluenzaA__AHG96902

SEQ ID NO: 85403 - RNA, 1410 nt, Artificial Sequence; identical to SEQ ID NO: 77464
  derived and/or modified sequence opt1 from neuraminidase__InfluenzaA__AHG96914

SEQ ID NO: 85404 - RNA, 1410 nt, Artificial Sequence; identical to SEQ ID NO: 77464
  derived and/or modified sequence opt1 from neuraminidase__InfluenzaA__AHG96926

SEQ ID NO: 85405 - RNA, 1410 nt, Artificial Sequence; identical to SEQ ID NO: 77464
  derived and/or modified sequence opt1 from neuraminidase__InfluenzaA__AHG96938

SEQ ID NO: 85406 - RNA, 1410 nt, Artificial Sequence; identical to SEQ ID NO: 77464
  derived and/or modified sequence opt1 from neuraminidase__InfluenzaA__AHG96950

SEQ ID NO: 85407 - RNA, 1410 nt, Artificial Sequence; identical to SEQ ID NO: 77464
  derived and/or modified sequence opt1 from neuraminidase__InfluenzaA__AHG96962

SEQ ID NO: 85408 - RNA, 1410 nt, Artificial Sequence; identical to SEQ ID NO: 77464
  derived and/or modified sequence opt1 from neuraminidase__InfluenzaA__AHG96974

SEQ ID NO: 85409 - RNA, 1410 nt, Artificial Sequence; identical to SEQ ID NO: 77464
  derived and/or modified sequence opt1 from neuraminidase__InfluenzaA__AHG96986

SEQ ID NO: 85410 - RNA, 1410 nt, Artificial Sequence; identical to SEQ ID NO: 77464
  derived and/or modified sequence opt1 from neuraminidase__InfluenzaA__AHG96998

SEQ ID NO: 85411 - RNA, 1410 nt, Artificial Sequence; identical to SEQ ID NO: 77464
  derived and/or modified sequence opt1 from neuraminidase__InfluenzaA__AHG97010

SEQ ID NO: 85412 - RNA, 1410 nt, Artificial Sequence; identical to SEQ ID NO: 77464
  derived and/or modified sequence opt1 from neuraminidase__InfluenzaA__AHG97022

SEQ ID NO: 85413 - RNA, 1410 nt, Artificial Sequence; identical to SEQ ID NO: 77464
  derived and/or modified sequence opt1 from neuraminidase__InfluenzaA__AHG97034

SEQ ID NO: 85414 - RNA, 1410 nt, Artificial Sequence; identical to SEQ ID NO: 77464
  derived and/or modified sequence opt1 from neuraminidase__InfluenzaA__AHG97046

SEQ ID NO: 85415 - RNA, 1410 nt, Artificial Sequence
  derived and/or modified sequence opt1 from neuraminidase__InfluenzaA__AHH00872
augaaccccaaccagaagaucaucaccaucggcagcgugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaacaucaccggguucgcccccuucuccaaggacaacagcauccgccucuccgccggcggggacaucugggugacccgggagcccuacgugagcugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgaagcaggucugcaucgccuggagcuccagcuccugccacgacggcaaggcguggcugcacgugugcgugaccggggacgacgagaacgccaccgccagcuucaucuacaacggccgccugguggacuccaucgggagcugguccaagaagauccuccggacccaggagagcgagugcgucugcaucaacggcacgugcaccgugaucaugaccgacggcuccgccagcgggaaggcggacaccaagauccuguucaucgaggagggcaagaucgugcacacgagcccccuguccgggagcgcccagcacgucgaggagugcuccugcuacccgcgcuaccccggcgugcggugcgugugccgcgacaacuggaagggcagcaaccggcccaucgucgacaucaacgugaaggacuacuccaucgugagcuccuacgucugcagcgggcucgugggcgacacgccccgcaagaacgacuccagcuccagcucccacugccuggacccgaacaacgaggagggcgggcacggggugaagggcugggccuucgacgacggcaacgacgucuggauggggcggaccaucagcgagaagucccgcagcggcuacgagaccuucaaggugaucgaggggugguccaagcccaacagcaagcugcagaucaaccggcaggucaucaucgaccgcggcaaccgguccggguacagcggcaucuucuccguggagggcaagagcugcaucaaccgcugcuucuacguggagcucauccgggggcgcaagcaggagaccgagguccuguggaccagcaacuccaucgugguguucugcggcaccagcgggaccuacggcacgggguccuggcccgacggcgccgaccugaaccucaugcccaucuga

SEQ ID NO: 85416 - RNA, 1416 nt, Artificial Sequence
  derived and/or modified sequence opt1 from neuraminidase__InfluenzaA__AHI43497
augaaccccaaccagaagcuguucgcccucagcggcguggccaucgcgcuguccauccugaaccuccugaucgggaucagcaacgucggccugaacaucucccuccaccugaaggggaagggcccgaagcaggaggagaaccugaccugcaccacgaucaaccagaacaacaccaccgugguggagaacaccuacgucaacaacacgaccaucaucaccaaggagaccgacuggaacacgcccagcuaccuccugcugaacaagucccucugcaacguggagggguggguggucaucgccaaggacaacgccauccgcuucggcgagagcgagcagaucaucgugacccgggagcccuacguguccugcgaccccaccggcugcaagauguacgcccugcaccaggggaccacgauccgcaacaagcacagcaacggcaccauccacgaccggaccgccuuccgcgggcugaucuccaccccgcucggcacgccgcccaccgucagcaacuccggguucaugugcgugggcuggagcuccacgaccugccacgacggcaucgggcggaugaccaucugcauccagggcaacaacgacaacgcgaccgccaccguguacuacaacgggcgccugaccacgaccaucaagaccugggcccggaacauccugcgcacccaggagagcgagugcgucugccacaacggcacgugcgccguggugaugaccgacggcuccgcgagcucccaggccuacaccaaggucauguacuuccacaaggggcucgugaucaaggaggaggcccugcggggcagcgcccgccacaucgaggagugcuccugcuacgggcacagccagcgggugaccugcgucugccgcgacaacuggcagggcgccaaccggcccaucaucgagaucgacaugaacacgcuggagcacaccagccgcuacgugugcaccgggauccucaccgacacgucccggcccggcgacaagagcuccggcgacugcagcaaccccaucaccgggucccccggcgcgcagggggugaagggcuucggguuccugaacggcgacaacaccuggcugggccgcaccaucagcccccggucccgcagcggguucgagaugcucaagaucccgaacgccggcaccgaccccaacucccggaucgccgagcgccaggagaucgucgacaacaacaacuggagcggguacuccggcagcuucaucgacuacuggaacaacaacuccgagugcuacaaccccugcuucuacguggagcugauccgggggcgccccgaggaggccaaguacgugugguggacgagcaacucccugaucgcccucugcggcagcccguuccccgucggcuccgggagcuuccccgacggcgcgcagauccaguacuucuccuga

SEQ ID NO: 85417 - RNA, 1410 nt, Artificial Sequence
  derived and/or modified sequence opt1 from neuraminidase__InfluenzaA__AHJ57439
augaaccccaaccagaagaucaucaccaucggcagcgugucccugaucaucagcaccaucugcuucuucaugcaggucgccauccuccugacgaccgugacccugcacuucaagcaguacgaguucaacuccccgcccaacaaccaggugaugcucugcgagcccaccaucaucgagcgcaacaucacggagaucgucuaccugaccaacaccaccaucgagaaggagaucugccccaagccggccgaguaccggaacuggagcaagccccagugcgacaucacgggguucgcgcccuucuccaaggacaacagcauccgccuguccgccggcggggacaucugggugacccgggagcccuacgugagcugcgacccggacaagugcuaccaguucgcccucggccaggggaccacccugaacaacguccacuccaacaacacggugcgcgaccggacccccuaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccgucgugagcugguccaaggacauccugcgcacccaggagagcgagugcgugugcaucaacgggaccugcacggucgugaugaccgacggguccgccagcggcaaggccgacaccaagauccucuucaucgaggagggcaagaucgugcacaccagcacgcuguccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccucgaccccaacaacgaggagggcggccacggggugaagggcugggccuucgacgacgggaacgacgucuggaugggccgcaccaucaacgagaccagccggcugggcuacgagacguucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcaccagcgggacguacggcaccggguccuggcccgacggcgccgacaucaaccugaugcccaucuga

SEQ ID NO: 85418 - RNA, 1410 nt, Artificial Sequence
  derived and/or modified sequence opt1 from neuraminidase__InfluenzaA__AHJ57440
augaaccccaaccagaagaucaucaccaucggcagcgugucccugaucaucagcaccaucugcuucuucaugcagaucgccauccucaucacgaccgucacccugcacuucaagcaguacgaguucaacuccccgcccaacaaccagaugaugcugugcgagcccaccaucaucgagcgcaacaucacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggugacccgggagcccuacgucagcugcgacccggacaagugcuaccaguucgcccugggccaggggaccacccucaacaacggccacuccaacaacacggugcgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccgucgugagcugguccaaggagauccugcgcacccaggagagcgagugcgugugcaucaacgggaccugcacggucgugaugaccgacggcuccgccagcggcaaggccgacaccaagauccuguucaucgaggaggggaagaucgugcacaccagcacgcucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggaccagcggcacguacgggaccggcuccuggcccgacggggccgacaucaaccugaugcccaucuga

SEQ ID NO: 85419 - RNA, 1410 nt, Artificial Sequence
  derived and/or modified sequence opt1 from neuraminidase__InfluenzaA__AHJ57441
augaaccccaaccagaagaucaucaccaucggcagcgugucccugaucaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaagacggagaucguguaccucaccaacaccaccaucgagaaggagaucugccccaagccggccgaguaccggaacuggagcaagccccagugcgacaucacgggguucgcgcccuucuccaaggacaacagcauccgccuguccgccggcggggacaucugggucacccgggagcccuacgugagcugcgacccggacaagugcuaccaguucgcccugggccaggggaccacccucaacaacgugcacuccaacaacacgguccacgaccgcacccccuaccggacccugcugaugaacgagcucggcgugcccuuccaccugggcaccaagcaggucugcaucgccuggagcuccagcuccugccacgacgggaaggccuggcugcacgugugcaucacgggcgacgacaagaacgcgaccgccagcuucaucuacaacgggcgccucguggacuccguggucagcugguccaaggagauccugcggacccaggagagcgagugcgugugcaucaacgggaccugcacgguggucaugaccgacggguccgccagcggcaaggccgacaccaagauccuguucaucgaggagggcaagaucgugcacaccagcacgcucuccgggagcgcgcagcacguggaggagugcuccugcuacccccgcuacccgggcguccggugcgugugccgcgacaacuggaaggggagcaaccggcccaucguggacaucaacaucaaggaccacuccaucgucagcuccuacgugugcagcggccuggugggcgacaccccgcgcaagaacgacuccagcuccagcucccacugccuggaccccaacaacgaggagggcggccacggggucaagggcugggccuucgacgacgggaacgacguguggaugggccggaccaucaacgagaccagccgccucggcuacgagacguucaaggucaucgaggggugguccaaccccaagagcaagcugcagaucaaccgccaggugaucguggaccggggcaaccgguccggguacagcggcaucuucuccgucgagggcaagagcugcaucaaccgcugcuucuacguggagcugauccgggggcgcaaggaggagaccgaggugcucuggaccagcaacuccaucgucguguucugcggcaccagcgggacguacggcaccggguccuggcccgacggcgccgacaucaaccugaugcccaucuga

SEQ ID NO: 85420 - RNA, 1413 nt, Artificial Sequence
  derived and/or modified sequence opt1 from neuraminidase__InfluenzaA__AHJ57654
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccacgaccaucaucaacaaccacccccagaacaacuucaccaacaucaccaacaucaucaugaacaagaacgaggagggcaacuuccugaaccucacgaagccccugugcgaggugaacagcuggcacauccuguccaaggacaacgcgauccgcaucggggagaacgcccacauccucgucacccgggagccguaccugagcugcgacccccagggcugccgcauguucgcccugucccagggcaccacccuccgggggcgccacgccaacggcacgauccacgaccggagccccuuccgcgcccugaucuccugggagauggggcaggcgcccagcccguacaacgcccggguggagugcaucggcugguccagcaccuccugccacgacgggaucagccgcauguccaucugcaucagcggccccaacaacaacgccuccgccguggucugguacggcgggcggcccgugaccgagauccccagcugggcgggcaacauccugcgcacccaggagagcgagugcgugugccacgggggcaucugcccggucgugaugacggacggccccgccaacaaccgggccgagaccaagaucaucuacuucaaggaggggaaggugcagaagaucgaggagcucaagggcaacgcccagcacaucgaggagugcuccugcuacggggccagcggcaugaucaagugcaucugccgcgacaacuggaagggggcgaaccggcccgucaucaccaucgaccccgagaugaugacccacacguccaaguaccugugcagcaagauccugaccgacaccucccgcccgaacgaccccaccaacggcaacugcgacgcccccaucacgggcgggagccccgacccgggcgugaagggguucgccuuccucgacggcgagaacuccuggcuggggcggaccaucagcaaggacucccgcagcggcuacgagaugcugaagauccccaacgccgagaccgacacccaguccggcgccaucagccaccagaucaucgugaacaaccagaacugguccggguacagcggcgcguucaucgacuacugggccaacaaggagugcuucaaccccugcuucuacgucgagcucauccgggggcgccccaaggaguccagcgugcuguggacguccaacagcaucguggcccugugcggcucccgggagcgccucgggagcuggagcuggcacgacggcgccgagaucaucuacuucaaguga

SEQ ID NO: 85421 - RNA, 1410 nt, Artificial Sequence
  derived and/or modified sequence opt1 from neuraminidase__InfluenzaA__AHJ57666
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccguggugaugaccgacggcagcgccagcggggucgcggacacgcggauccucuucauccgcgagggcaagaucgugcacaucagcccccuguccggcuccgcccagcacaucgaggagugcagcugcuacccccgguaccccgacgugcgcugcgucugccgggacaacuggaagggguccaaccgcccggugaucgacaucaacauggccgacuacagcaucgacuccaacuacgugugcagcggccuggucggggacacgccccggaacgacgacaacuccagcuccagcaacugccgcgaccccaacaacgagcggggcaaccccggggugaagggcugggccuucgacgacggcaacgacguguggauggggcgcaccaucaaccgggacucccgcagcggcuacgagaccuuccgggucaucgggggcuggaccaccgccaacuccaagagccagaucaaccgccaggugaucgucgacaacaacaacugguccggguacagcggcguguucuccguggagggcaagagcugcaucaaccgcugcuucuacgucgagcucaucaaggggcggccgcaggagccccgcgugugguggaccagcaacuccaucguggucuucugcggcaccagcgggacguacggcaccggguccuggcccgacggcgcgaacaucaacuucaugcccaucuga

SEQ ID NO: 85422 - RNA, 1413 nt, Artificial Sequence
  derived and/or modified sequence opt1 from neuraminidase__InfluenzaA__AHJ57677
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaacaugaacgagaccucccccaccacgaccgugaucaacaaccacccccagaacaacuucaccaacaucaccaacaucaucgucaacaagaacgaggaggagaacuuccugaaccugacgaagccccucugcgaggugaacagcuggcacauccuguccaaggacaacgcgauccgcaucggcgagaacgcccacauccuggugacccgggagccguaccucagcugcgacccccaggggugccgcauguucgcccugucccagggcaccacccugcggggccagcacgccaacgggacgauccacgaccgcagccccuuccgggcccucaucuccugggagaugggccaggcgcccagcccguacaacgcccgcgucgagugcaucgggugguccagcaccuccugccacgacggcaucagccggauguccaucugcaucagcgggcccaacaacaacgccuccgccguggugugguacggcggccgccccgucaccgagauccccagcugggcggggaacauccugcggacccaggagagcgagugcgugugccacggcgggaucugcccgguggucaugacggacggccccgccaacaaccgcgccgagaccaagaucaucuacuucaaggagggcaagauccagaagguggaggagcugaaggggaacgcccagcacaucgaggagugcuccugcuacggcgccagcgggaugaucaagugcaucugccgggacaacuggaagggcgcgaaccgccccgugaucaccaucgaccccgagaugaugacccacacguccaaguaccucugcagcaagauccugaccgacaccucccggccgaacgaccccaccaacgggaacugcgacgcccccaucacgggcggcagccccgacccgggggucaagggcuucgccuuccuggacggggagaacuccuggcucggccgcaccaucagcaaggacucccggagcggguacgagaugcugaaggugcccaacgccgagaccgacacccaguccggcgccaucagccaccagaugaucgugaacaaccagaacugguccggcuacagcggggcguucaucgacuacugggccaagaaggagugcuucaaccccugcuucuacgucgagcugauccgcggccggcccaaggaguccagcgugcucuggacguccaacagcaucguggcccugugcgggucccgcgagcggcugggcagcuggagcuggcacgacggggccgagaucaucuacuucaaguga

SEQ ID NO: 85423 - RNA, 1413 nt, Artificial Sequence
  derived and/or modified sequence opt1 from neuraminidase__InfluenzaA__AHJ57689
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaagaugaacgagaccucccccaccacgaccaucaucaacaaccacccccagaacaacuucaccaacaucaccaacaucaucgugaacaagaacgaggaggagaacuuccugaaccugacgaagccccucugcgaggucaacagcuggcacauccuguccaaggacaacgcgauccgcaucggcgagaacgcccacauccuggugacccgggagccguaccucagcugcgacccccaggggugccgcauguucgcccugucccagggcaccacccugcggggccagcacgccaacgggacgauccacgaccgcagccccuuccgggcccucaucuccugggagaugggccaggcgcccagcccguacaacgcccgcguggagugcaucgggugguccagcaccuccugccacgacggcaucagccggauguccaucugcaucagcgggcccaacaacaacgccuccgccgucgugugguacggcggccgccccgugaccgagauccccagcugggcggggaacauccugcggacccaggagagcgagugcgucugccacggcgggaucugcccgguggugaugacggacggccccgccaacaaccgcgccgagaccaagaucaucuacuucaaggagggcaagauccagaagaucgaggagcugaaggggaacgcccagcacaucgaggagugcuccugcuacggcgccagcgggaugaucaagugcaucugccgggacaacuggaagggcgcgaaccgccccgucaucaccaucgaccccgagaugaugacccacacguccaaguaccucugcagcaagauccugaccgacaccucccggccgaacgaccccaccaacgggaacugcgacgcccccaucacgggcggcagccccgacccgggggugaagggcuucgccuuccuggacggggagaacuccuggcucggccgcaccaucagcaaggacucccggagcggguacgagaugcugaaggugcccaacgccgagaccgacacccaguccggcgccaucagccaccagaucaucgucaacaaccagaacugguccggcuacagcggggcguucaucgacuacugggccaacaaggagugcuucaaccccugcuucuacguggagcugauccgcggccggcccaaggaguccagcgugcucuggacguccaacagcaucgucgcccugugcgggucccgcgagcggcugggcagcuggagcuggcacgacggggccgagaucaucuacuucaaguga

SEQ ID NO: 85424 - RNA, 1413 nt, Artificial Sequence
  derived and/or modified sequence opt1 from neuraminidase__InfluenzaA__AHJ57700
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccacgaccaucaucaacaaccacccccagaacaacuucaccaacaucaccaacaucaucaugaacaagaacgaggagggcaacuuccugaaccucacgaagccccugugcgaggugaacagcuggcacauccuguccaaggacaacgcgauccgcaucggggagaacgcccacauccucgucacccgggagccguaccugagcugcgacccccagggcugccgcauguucgcccugucccagggcaccacccuccgggggcgccacgccaacggcacgauccacgaccggagccccuuccgcgcccugaucuccugggagauggggcaggcgcccagcccguacaacgcccggguggagugcaucggcugguccagcaccuccugccacgacgggaucagccgcauguccaucugcaucagcggccccaacaacaacgccuccgccguggucugguacggcgggcggcccgugaccgagauccccagcugggcgggcaacauccugcgcacccaggagagcgagugcgugugccacgggggcaucugcccggucgugaugacggacggccccgccaacaaccgggccgagaccaagaucaucuacuucaaggaggggaaggugcagaagaucgaggagcucaagggcaacgcccagcacaucgaggagugcuccugcuacggggccagcggcaugaucaagugcaucugccgcgacaacuggaagggggcgaaccggcccgucaucaccaucgaccccgagaugaugacccacacguccaaguaccugugcagcaagauccugaccgacaccucccgcccgaacgaccccaccaacggcaacugcgacgcccccaucacgggcgggagccccgacccgggcgugaagggguucgccuuccucgacggcgagaacuccuggcuggggcggaccaucagcaaggacucccgcagcggcuacgagaugcugaaggugcccaacgccgagaccgacacccaguccggcgccaucagccaccagaucaucgucaacaaccagaacugguccggguacagcggcgcguucaucgacuacugggccaacaaggagugcuucaaccccugcuucuacguggagcucauccgggggcgccccaaggaguccagcgugcuguggacguccaacagcaucgucgcccugugcggcucccgggagcgccucgggagcuggagcuggcacgacggcgccgagaucaucuacuucaaguga

SEQ ID NO: 85425 - RNA, 1410 nt, Artificial Sequence
  derived and/or modified sequence opt1 from neuraminidase__InfluenzaA__AHJ57710
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucuccagcugguccaagaacauccugcgcacccaggagagcgagugcgugugcaucaacgggaccugcgccguggugaugaccgacggcagcgccuccggcgucgcggacacgcggauccucuucauccgcgaggggaagaucgugcacaucagcccccuguccggcagcgcccagcacaucgaggagugcuccugcuacccccgguaccccgacgugcgcugcgucugccgggacaacuggaagggcagcaaccgcccggugaucaacaucaacauggccgacuacuccaucgacagcaacuacgugugcuccgggcuggucggcgacacgccccggaacgacgacaacagcuccagcuccaacugccgcgaccccaacaacgagcgggggaaccccggcgugaaggggugggccuucgacgacggcaacgacguguggaugggccgcaccaucaaccgggacagccgcuccggguacgagaccuuccgggucaucggcggguggaccaccgccaacagcaagucccagaucaaccgccaggugaucgucgacaacaacaacuggagcggcuacuccgggguguucagcguggagggcaagagcugcaucaaccgcugcuucuacgucgagcucauccggggccgcccgcaggagccccgggugugguggaccuccaacagcaucguggucuucugcgggaccuccggcacguacgggaccggcagcuggcccgacggggcgaacaucaacuucaugcccaucuga

SEQ ID NO: 85426 - RNA, 1410 nt, Artificial Sequence
  derived and/or modified sequence opt1 from neuraminidase__InfluenzaA__AHJ57734
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggcggaguaccggaacuggagcaagccgcagugcaagaucacgggguucgcccccuucuccaaggacaacagcauccgccuguccgccggcggggacaucugggucacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgugccguuccaccuggggaccaagcaggucugcaucgccugguccagcuccagcugccacgacggccgcgcguggcuccacaucugcaucaccggggacgaccggaacgccacggccuccuucaucuacgacggcaugcugguggacagcaucggcuccuggagcaagaacauccugcgcacccaggaguccgagugcgugugcaucaacgggaccugcgccgucgugaugaccgacggcagcgcgagcgggguggccgacacgcggauccucuucauccgcgagggcaagaucguccacaucagcccccuguccggcuccgcccagcacaucgaggagugcagcugcuacccccgguaccccgacgugcgcugcgugugccgggacaacuggaagggguccaaccgcccggucaucaacaucaacauggccgacuacagcaucgacuccaacuacgugugcagcggccuggugggggacacgccccggaacgacgacaacuccagcuccagcaacugccgcgaccccaacaacgagcggggcaaccccggggucaagggcugggccuucgacgacggcaacgacguguggauggggcgcaccaucaaccgggacucccgcagcggcuacgagaccuuccgggugaucgggggcuggaccaccgcgaacuccaagagccagaucaaccgccaggucaucguggacaacaacaacugguccggguacagcggcgucuucuccguggagggcaagagcugcaucaaccgcugcuucuacguggagcucauccgggggcgcccgcaggagccccgggucugguggaccagcaacuccaucgugguguucugcggcaccagcgggacguacggcaccggguccuggcccgacggcgccaacaucaacuucaugcccaucuga

SEQ ID NO: 85427 - RNA, 1380 nt, Artificial Sequence
  derived and/or modified sequence opt1 from neuraminidase__InfluenzaA__AHJ57746
augaaccccaaccagaagaucaucaccaucggcagcguguccaucaccaucgccgccgucugcuuccugaugcagaucgcgauccucgccacgaccgugacccugcacuucaagcagaacgagugcaacaucccgagcaagaaccacgugauccccugcgagcccaucaucaucgagcgcaacaucaccgaggucgagauccggcccaagguggccgaguaccgcgacugguccaagccgcagugccagaucacgggguucgcccccuucagcaaggacaacuccauccggcugagcgccggcgggaacaucugggugacccgcgagcccuacgucuccugcggccccgacaagugcuaccaguucgcgcucgggcagggcaccacccugggcaacgggcacagcaacggcacgauccacgacaagaucccgcaccggacccugcucaugaacgagcugggggugcccuuccaccugggcaccaagcaggucugcaucgccugguccagcuccagcugccacgacgggcgcgccuggcuccacgugugcgugaccggcgacgaccggaacgccacggcguccuucaucuacgacggcaugcugguggacagcaucgccuccuggagccagaacauccugcgcacccaggaguccgagugcgucugcaucaacgggaccugcaccguggugaugacggacggcagcgccuccggggucgccgacacccggauccucuucauccgcgagggcaagaucgugcacaucagcccccugagcggcuccgcccagcacaucgaggagugcagcugcuacccccggcacuccgacgugcgcugcgucugccgggacaacuggaaggggagcaaccgcccggugguggacaucaacaugaccgacuacuccaucgacagcuccuacgucugcagcggccuggugggggacacgccccggaacgacgacuccagcuccagcuccaacugccgcgaccccaacaacgagcggggcaaccccggggugaagggcugggcguucgacgacggcgacgacgucuggauggggcgcaccaucagccgggacucccgcagcggcuacgagaccuuccgggugaucgggggcuggaccaccgccaacuccaagagccagaucaaccgccaggucaucguggacaacaacaacugguccggguacagcggcguguucagcgucgagggcaaguccugcaucaaccgcugcuucuacguggagcucauccgggggcgcccgcaggagacgcgggugugguggaccagcaacuccaucgucguguucugcggcaccagcgggaccuacggcacgggguccuggcccgacggcgccaacaucaacuucaugcccaucuga

SEQ ID NO: 85428 - RNA, 1410 nt, Artificial Sequence
  derived and/or modified sequence opt1 from neuraminidase__InfluenzaA__AHJ57758
augaaccccaaccagaagaucaucaccgugggcagcgucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucagcaaggacaacuccauccgccugagcgccggcggggacaucugggugacccgggagcccuacguguccugcagccccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggagcuccagcuccugccacgacggccgcgccuggcuccacgugugcaucacgggggacgaccggaacgccaccgccagcuucaucuacaacggcaugcugguggacuccaucagcuccuggagccgcaacauccugcggacccaggagagcgagugcgugugcaucaacgggaccugcacggugaucaugaccgacggcuccgcgagcggcgucgccgacacccgcauccucuucauccgggaggggaacaucgugcacgugagcccccuguccggcuccgcccagcacaucgaggagugcagcugcuacccccgcuacccggacguccggugcgugugccgcgacaacuggaagggguccaaccggcccguggucgacaucaacauggccgacuacagcaucgacucccacuacgugugcagcggccuggugggcgacacgccccgcaacgacgacuccagcuccagcuccaacugcaaggaccccaacaacgagcgggggaacccgggcgucaaggggugggccuucgacgacggcaacgacguguggauggggcgcaccaucagccgggacucccgcagcggcuacgagaccuuccgggucaucggcggguggaccaccgcgaacuccaagagccagaucaaccgccaggugaucguggacaacaacaacuggagcggcuacuccggggucuucagcguggagggcaaguccugcaucaaccgcugcuucuacguggagcucauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 85429 - RNA, 1401 nt, Artificial Sequence
  derived and/or modified sequence opt1 from neuraminidase__InfluenzaA__AHJ57770
augaaccccaaccagaagaucaucgccaucggcagcgugucccugaccaucgccaucaucugcuuccucaugcagaucgcgauccugaccacgaccaugacccugcacuucaagcagaacgagugcagcaacccguccaacaaccaggucgugcccugcgagcccaucaucaucgagcgcaacaccgugcaccucaacagcacgaccaucgagaaggagaucugccccaaggucguggaguacaagaacugguccaagccgcagugccagaucaccggguucgcccccuucagcaaggacaacuccauccggcugagcgccggcggggacaucugggugacccgcgagcccuacgucuccugcagccugggcaagugcuaccaguucgcccucgggcagggcacgacccugaagaacaagcacuccaacggcaccacccacgaccggaucccccaccgcacgcugcucaugaacgagcugggggugccguuccaccugggcaccaagcaggucugcaucgccuggagcuccagcuccugcuacgacgggaaggcguggcuccacaucugcgugaccggcgacgacaagaacgccaccgccagcaucaucuacgacgggaugcugguggacuccaucggcagcugguccaagaacauccugcggacgcaggagagcgagugcgugugcaucaacgggaccugcgccgucgugaugaccgacggcagcgcguccggcaaggccgacacccgcauccucuucauccgggaggggaagaucaucaacaucagcccccuguccggcagcgcccagcacguggaggagugcuccugcuacccccgcuaccccgagguccggugcgugugccgcgacaacuggaagggcagcaaccggccggugcuguacaucaacauggccgacuacuccgucgagagcuccuacgugugcagcgggcucgugggcgacacgccccgcaacgacgacuccagcuccagcuccaacugccgggaccccaacaacgagcgcggggcccccggcgucaaggggugggcguucgacgacggcaacgacguguggaugggccggaccaucaagaacgacagccgcuccggguacgagaccuuccggguggucaacggcuggaccacggccaacagcaagucccagaucaaccgccaggugaucgucgacagcgagaacuggagcggguacuccggcaucuucagcguggaggggaagaacugcaucaaccggugcuucuacguggagcugauccgcggccggccgcaggagccccgcgucugguggaccuccaacagcaucaucguguucugcggcaccuccgggaccuacggcacggggagcuggcccgacggcgccaacaucaacuuccugcccaucuga

SEQ ID NO: 85430 - RNA, 1410 nt, Artificial Sequence
  derived and/or modified sequence opt1 from neuraminidase__InfluenzaA__AHJ57782
augaaccccaaccagaagaucaucaucaucggcagcgugucccugaccaucgccaccgucugcuuccucaugcagaucgccauccuggcgacgaccgugacccugcacuucaagcagaacgagugcaacaucccgagcaagaaccaggugguccccugcgagcccaucaucaucgagcgcaacaucaccgaggugguguaccucaacaacacgaccaucgagaaggagaucugccccgccgucguggaguaccggaacugguccaagccgcagugccagaucaagggguucgcccccuucagcaaggacaacuccauccgccugagcgccggcggggacaugugggugacccgggagcccuacgucuccugcagccccuccaagugcuaccaguucgcccugggccaggggaccacgcucgacaacaaccacagcaacggcaccauccacgaccgcaucccgcaccggacccugcugaugaacgagcucggcgugcccuuccaccuggggaccaagcaggucugcaucgcgugguccagcuccagcugccacgacggcaaggccuggcugcacgugugcgugacgggggacgaccgcaacgccaccgccuccuucaucuacgacggcaugcucguggacagcaucggguccuggagccagaacauccugcggacccaggaguccgagugcgucugcaucaacgggaccugcacgguggugaugaccgacggcagcgcgagcggcaucgccgacacccgcauccuguucguccgggagggcaagaucgugcacaucagcccccucuccggguccgcccagcacaucgaggagugcagcugcuacccccgcuacccggacgugcggugcgucugccgcgacaacuggaagggcuccaaccggcccaucguggacaucaacauggccgacuacagcaucggcuccagcuacgugugcuccgggcuggucggcgacacgccccgcaacgacgaccgguucagcuccagcaacugccgcgaccccaacuccgagcgggggaacccgggcgugaaggggugggccuucgacgacggcgacgacgucuggaugggccgcaccaucagccgggacucccgcagcggguacgagaccuuccgggugaucggcggguggaccaccgcgaacuccaagagccagaucaaccgccaggugaucgucgacaacaacaacugguccggcuacagcgggguguucagcguggagggcaaguccugcaucaaccgcugcuucuacgucgagcugauccggggccgcccccaggagacgcgggugugguggaccagcaacuccaucguggucuucugcgggaccagcggcaccuacgggacgggcuccuggcccgacggggccaacaucaacuucaugcccaucuga

SEQ ID NO: 85431 - RNA, 1410 nt, Artificial Sequence
  derived and/or modified sequence opt1 from neuraminidase__InfluenzaA__AHJ57794
augaaccccaaccagaagaucaucaccgugggcagcgucucccuggccaucgccaccaucugcuuccucaugcagaucgcgauccuggccacgaccgugacccugcacuucaagcagaacgagugcaacaucccgagcaagaaccaggugaugcccugcgagcccaucaucaucgagcgcaacaucaccgaggucguguaccucaacaacacgaucaucgagaaggagaucugccccaagguggucgaguaccggaacugguccaagccgcagugccagaucaccggguucgcccccuucagcaaggacaacuccauccgccugagcgccggcggggacaucugggugacccgggagcccuacguguccugcagccccuccaagugcuaccaguucgcccugggccaggggaccacgcucgacaacagccacuccaacggcaccauccacgaccgcaucccgcaccggacccugcugaugaacgagcucggcguccccuuccaccuggggaccaagcaggucugcaucgcguggagcuccagcuccugccacgacggccgcgccuggcugcacgugugcaucacgggggacgaccggaacgccaccgccagcuucaucuacaacggcaugcucguggacuccaucagcuccuggagccgcaacauccugcggacccaggagagcgagugcgugugcaucaacgggaccugcacggugaucaugaccgacggcuccgcgagcggcgucgccgacacccgcauccuguucauccgggaggggaacaucgugcacgugagcccccucuccggcuccgcccagcacaucgaggagugcagcugcuacccccgcuacccggacguccggugcgugugccgcgacaacuggaagggguccaaccggcccguggucgacaucaacauggccgacuacagcaucgacucccacuacgugugcagcggccuggugggcgacacgccccgcaacgacgacuccagcuccagcuccaacugcaaggaccccaacaacgagcgggggaacccgggcgucaaggggugggccagcgacgacggccacgacguguggauggggcgcaccaucggccgggacucccgcagcggcuacgagaccuuccgggucaucgggggcuggaccaccgcgaacuccaagagccagaucaaccgccaggugaucguggacaacaacaacuggagcggguacuccggcgucuucagcguggaggggaaguccugcaucaaccgcugcuucuacguggagcugauccggggccgcccccaggagacgcgggucugguggaccagcaacuccaucgugguguucugcggcaccagcgggaccuacggcacgggguccuggcccgacggcgccaacaucaacuucaugcccaucuga

SEQ ID NO: 85432 - RNA, 1413 nt, Artificial Sequence
  derived and/or modified sequence opt1 from neuraminidase__InfluenzaA__AHJ57806
augaaccccaaccagaagaucacgugcaucagcgccaccggcaugacccuguccguggucagccuccugaccgggaucgccaaccugggccucaacaucgggcugcacuacaagguguccgacagcaccaacaucuccaucccgaacaugaacgaggcgagccccaccacgaccaucaucaacaaccacccccagaacaacuucaccaacaucaccaacaucaucaugaacaagaacgaggagggcaacuuccugaaccucacgaagccccugugcgaggugaacuccuggcacauccugagcaaggacaacgccauccgcaucggggagaacgcccacauccucgucacccgggagccguaccuguccugcgacccccagggcugccgcauguucgcccugagccagggcaccacccuccgggggcgccacgccaacggcacgauccacgaccggucccccuuccgcgcgcugaucagcugggagauggggcaggcccccuccccguacaacgcccggguggagugcaucggcuggagcuccaccagcugccacgacgggaucucccgcaugagcaucugcaucuccggccccaacaacaacgccagcgcgguggucugguacggcgggcggcccgugaccgagauccccagcugggccggcaacauccugcgcacccaggaguccgagugcgugugccacgggggcaucugcccggucgugaugacggacggccccgccaacaaccgggccgagaccaagaucaucuacuucaaggaggggaagauccagaagaucgaggagcucaagggcaacgcccagcacaucgaggagugcagcugcuacggggcguccggcaugaucaagugcaucugccgcgacaacuggaagggggccaaccggcccgugaucaccaucgaccccgagaugaugacccacacgagcaaguaccugugcuccaagauccugaccgacaccagccgcccgaacgaccccaccaacggcaacugcgacgcccccaucacgggcgggucccccgacccgggcgucaagggguucgccuuccucgacggcaagaacagcuggcuggggcggaccaucuccaaggacagccgcuccggcuacgagaugcugaaggugcccaacgccgagaccgacacccagagcggcgcgaucucccaccagaucaucgugaacaaccagaacuggagcggguacuccggcgccuucaucgacuacugggccaacaaggagugcuucaaccccugcuucuacgucgagcucauccgggggcgccccaaggagagcuccgugcuguggacgagcaacuccaucguggcccugugcggcagccgggagcgccucgggagcugguccuggcacgacggcgccgagaucaucuacuucaaguga

SEQ ID NO: 85433 - RNA, 1380 nt, Artificial Sequence
  derived and/or modified sequence opt1 from neuraminidase__InfluenzaA__AHJ57818
augaaccccaaccagaagaucacgugcaucagcgccaccggcgugacgcuguccgucgugagccuccugaucgggaucgccaaccugggccucaacaucgggcugcacuacaagguguccgacagcccgaccaucaacauccccaacaugaacgagaccaaccccaucaccacgaacaucaccaacaucaucgucaacaagaacgaggagggcaccuuccugaaccucaccaagccccugugcgaggugaacuccuggcacauccugagcaaggacaacgcgauccgcaucggggaggacgcccacauccucgugacgcgggagccguaccuguccugcgacccccagggcugccgcauguucgcccugagccagggcaccacccuccgggggcgccacgccaacggcaccauccacgaccggucccccuuccgcgcccugaucagcugggagauggggcaggcgcccuccccguacaacacgcgggucgagugcaucggcuggagcuccaccagcugccacgacgggaucucccgcaugagcaucugcaucuccggccccaacaacaacgccagcgccguggugugguaccggggccgccccgucaccgagauccccuccugggccgggaacauccugcggacccaggagagcgagugcgugugccacaagggcaucugcccgguggucaugacggacgggcccgcgaacaacaaggccgccaccaagaucaucuacuucaaggagggcaagauccagaagaucgaggagcuccagggcaacgcccagcacaucgaggagugcagcugcuacggggccgcgggcaugaucaagugcgugugccgcgacaacuggaagggggccaaccggcccaucaucaccaucgaccccgagaugaugacccacacguccaaguaccugugcagcaagauccugaccgacaccucccgcccgaacgaccccaccgacggcaacugcgacgcccccaucaccgggggcagccccgacccgggcgugaagggguucgccuuccucgagggcgagaacuccuggcuggggcggaccaucagcaaggacucccgcagcggcuacgagaugcugaagguccccaacgccgagaccgacacccaguccggggcgaucagccaccagaugaucgugaacaaccagaacugguccggcuacagcggcgccuucaucgacuacugggccaacaaggagugcuucaaccccugcuucuacguggagcucauccgggggcgccccaaggaguccagcguccuguggacguccaacagcaucguggcccugugcggcucccgggagcgccucgggagcugguccuggcacgacggcgccgagaucaucuacuucaaguga

SEQ ID NO: 85434 - RNA, 1410 nt, Artificial Sequence
  derived and/or modified sequence opt1 from neuraminidase__InfluenzaA__AHJ57830
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccaucgagaaggagaucugccccaaggugguggaguaccggaacuggagcaagccgcagugcaagaucacgggguucgcgcccuucuccaaggacaacagcauccgccuguccgccggcggggacaucugggucacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgugccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccgucgugaugaccgacggcagcgccagcgggguggcggacacgcggauccucuucauccgcgagggcaagaucguccacaucagcccccuguccggcuccgcccagcacaucgaggagugcagcugcuacccccgguaccccgacgugcgcugcgugugccgggacaacuggaagggguccaaccgcccggucaucgacaucaacauggccgacuacagcaucgacuccaacuacgugugcagcggccuggugggggacacgccccggaacgacgacaacuccagcuccagcaacugccgcgaccccaacaacgagcggggcaaccccggggucaagggcugggccuucgacgacggcaacgacguguggauggggcgcaccaucaaccgggacucccgcagcggcuacgagaccuuccgggugaucgggggcuggaccaccgccaacuccaagagccagaucaaccgccaggucaucguggacaacaacaacugguccggguacagcggcgucuucuccguggagggcaagagcugcaucaaccgcugcuucuacguggagcucauccgggggcgcccgcaggagccccgggucugguggaccagcaacuccaucgugguguucugcggcaccagcgggacguacggcaccggguccuggcccgacggcgcgaacaucaacuucaugcccaucuga

SEQ ID NO: 85435 - RNA, 1413 nt, Artificial Sequence
  derived and/or modified sequence opt1 from neuraminidase__InfluenzaA__AHJ57842
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaagaugaacgagaccaaccccaccacgaccaucaucaacaaccacccccagaacaacuucaccaacaucaccaacaucaucgugaacaagaacgaggaggagaacuuccugaaccugacgaagccccucugcgaggucaacuccuggcacauccugagcaaggacaacgcgauccgcaucggcgagaacgcccacauccuggugacccgggagccguaccucuccugcgacccccaggggugccgcauguucgcccugagccagggcaccaccauccggggccagcacgccaacgggacgauccacgaccgcucccccuuccgggcccugaucagcugggagaugggccaggcgcccuccccguacaacgcccgcguggagugcaucggguggagcuccaccagcugccacgacggcaucucccggaugagcaucugcaucuccgggcccaacaacaacgccagcgccgucgugugguacggcggccgccccgugaccgagauccccuccugggcggggaacauccuccggacccaggagagcgagugcgucugccacggcgggaucugcccgguggugaugacggacggccccgccaacaaccgcgccgagaccaagaucaucuacuucaaggagggcaagauccagaagaucgaggagcugaaggggaacgcccagcacaucgaggagugcagcugcuacggcgccuccgggaugaucaagugcaucugccgggacaacuggaagggcgcgaaccgccccgucaucaccaucgaccccgagaugaugacccacacgagcaaguaccugugcuccaagauccucaccgacaccagccggccgaacgaccccaccaacgggaacugcgacgcccccaucacgggcggcuccagcgaccccggggugaagggcuucgccuuccuggacggggagaacuccuggcugggccgcaccaucagcaaggacucccggagcggguacgagaugcucaaggugccgaacgccgagaccgacacccaguccggcgccaucagccaccagaucaucgucaacaaccagaacugguccggcuacagcggggcguucaucgacuacugggccaacaaggagugcuucaaccccugcuucuacguggagcugauccgcggccggcccaaggaguccagcgugcuguggacguccaacagcaucgucgcccucugcgggucccgcgagcggcugggcagcuggagcuggcacgacggggccgagaucaucuacuucaaguga

SEQ ID NO: 85436 - RNA, 1413 nt, Artificial Sequence
  derived and/or modified sequence opt1 from neuraminidase__InfluenzaA__AHJ57853
augaaccccaaccagaagaucacgugcaucagcgccaccggcaugacccuguccguggucagccuccugaucgggaucgccaaccugggccucaacguggggcugcacuacaaggugaacgacccgaccaacaucaacauccccaacaugaacgagaccucccccaccacgaccaucaucaacaaccacccccagaacaacuucaccaacaucaccaacaucaucgucaacaagaacgaggaggagaacuuccugaaccucacgaagccgcugugcgaggugaacagcuggcacauccuguccaaggacaacgcgauccgcaucggcgagaacgcccacauccucgugacccgggagcccuaccugagcugcgacccccaggggugccgcauguucgcccugucccagggcaccacccuccggggccagcacgccaacgggacgauccacgaccgcagccccuuccgggcccugaucuccugggagaugggccaggcgccgagccccuacaacgcccgcgucgagugcaucgggugguccagcaccuccugccacgacggcaucagccggauguccaucugcaucagcgggcccaacaacaacgccuccgccguggugugguacggcggccgccccgucaccgagaucccgagcugggcggggaacauccugcggacccaggaguccgagugcgugugccacggcgggaucugccccguggucaugacggacggccccgccaacaaccgcgccgagaccaagaucaucuacuucaaggagggcaagauccagaagaucgaggagcucaaggggaacgcccagcacaucgaggagugcagcugcuacggcgccagcgggaugaucaagugcaucugccgggacaacuggaagggcgcgaaccgccccgugaucaccaucgacccggagaugaugacccacacguccaaguaccugugcagcaagauccugaccgacaccucccggcccaacgaccccaccaacgggaacugcgacgcccccaucacgggcggcagcccggaccccggggugaagggcuucgccuuccucgacggggagaacuccuggcugggccgcaccaucagcaaggacucccggagcggguacgagaugcugaagguccccaacgccgagaccgacacccaguccggcgccaucagccaccagaugaucgugaacaaccagaacugguccggcuacagcggggcguucaucgacuacugggccaacaaggagugcuucaaccccugcuucuacguggagcucauccgcggccggccgaaggaguccagcguccuguggacguccaacagcaucguggcccugugcgggucccgcgagcggcucggcagcugguccuggcacgacggggccgagaucaucuacuucaaguga

SEQ ID NO: 85437 - RNA, 1413 nt, Artificial Sequence
  derived and/or modified sequence opt1 from neuraminidase__InfluenzaA__AHJ57865
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaagaugaacgagaccaaccccaccacgaccaucaucaacaaccacccccagaacaacuucaccaacaucaccaacaucaucgugaacaagaacgaggaggagaacuuccugaaccugacgaagccccucugcgaggucaacuccuggcacauccugagcaaggacaacgcgauccgcaucggcgagaacgcccacauccuggugacccgggagccguaccucuccugcgacccccaggggugccgcauguucgcccugagccagggcaccacccugcggggccgccacgccaacgggacgauccacgaccggucccccuuccgcgcccucaucagcugggagaugggccaggcgcccuccccguacaacgcccggguggagugcaucggguggagcuccaccagcugccacgacggcaucucccgcaugagcaucugcaucuccgggcccaacaacaacgccagcgccgucgugugguacggcggccggcccgugaccgagauccccuccugggcggggaacauccugcgcacccaggagagcgagugcgucugccacggcgggaucugcccgguggugaugacggacggccccgccaacaaccgggccgagaccaagaucaucuacuucaaggagggcaagauccagaagaucgaggagcugaaggggaacgcccagcacaucgaggagugcagcugcuacggcgccuccgggaugaucaagugcaucugccgcgacaacuggaagggcgcgaaccggcccgucaucaccaucgaccccgagaugaugacccacacgagcaaguaccucugcuccaagauccugaccgacaccagccgcccgaacgaccccaccaacgggaacugcgacgcccccaucacgggcggcucccccgacccgggggugaagggcuucgccuuccuggacggggagaacagcuggcucggccggaccaucuccaaggacagccgcuccggguacgagaugcugaaggugcccaacgccgagaccgacacccagagcggcgccaucucccaccagaugaucgucaacaaccagaacuggagcggcuacuccggggcguucaucgacuacugggccaacaaggagugcuucaaccccugcuucuacguggagcugauccggggccgccccaaggagagcuccgugcucuggacgagcaacuccaucgucgcccugugcgggagccgggagcgccugggcuccuggagcuggcacgacggggccgagaucaucuacuucaaguga

SEQ ID NO: 85438 - RNA, 1413 nt, Artificial Sequence
  derived and/or modified sequence opt1 from neuraminidase__InfluenzaA__AHJ57876
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccacgaccaucaucaacaaccacccccagaacaacuucaccaacaucaccaacaucaucaugaacaagaacgaggagggcaacuuccugaaccucacgaagccccugugcgaggugaacagcuggcacauccuguccaaggacaacgcgauccgcaucggggagaacgcccacauccucgucacccgggagccguaccugagcugcgacccccagggcugccgcauguucgcccugucccagggcaccacccuccgggggcgccacgccaacggcacgauccacgaccggagccccuuccgcgcccugaucuccugggagauggggcaggcgcccagcccguacaacgcccggguggagugcaucggcugguccagcaccuccugccacgacggcaagagccgcauguccaucugcaucagcgggcccaacaacaacgccuccgccguggucugguacggcgggcggcccaucaccgagauccccagcugggcgggcaacauccugcgcacccaggagagcgagugcgugugccacgggggcaucugcccgguggucaugacggacggccccgccaacaaccgggccgagaccaagaucaucuacuucaaggaggggaaggugcagaagaucgaggagcucaagggcaacgcccagcacaucgaggagugcuccugcuacggggccagcggcaugaucaagugcaucugccgcgacaacuggaagggggcgaaccggcccgugaucaccaucgaccccgagaugaugacccacacguccaaguaccugugcagcaagauccugaccgacaccucccgcccgaacgaccccaccaacggcaacugcgacgcccccaucacgggcgggagccccgacccgggcgucaagggguucgccuuccucgacggcgagaacuccuggcuggggcggaccaucagcaaggacucccgcagcggcuacgagaugcugaaggugcccaacgccgagaccgacacccaguccggcgccaucagccaccagaucaucgugaacaaccagaacugguccggguacagcggcgcguucaucgacuacugggccaacaaggagugcuucaaccccugcuucuacgucgagcucauccgggggcgccccaaggaguccagcgugcuguggacguccaacagcaucguggcccugugcggcucccgggagcgccucgggagcuggagcuggcacgacggcgccgagaucaucuacuucaaguga

SEQ ID NO: 85439 - RNA, 1413 nt, Artificial Sequence
  derived and/or modified sequence opt1 from neuraminidase__InfluenzaA__AHJ57888
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaacaugaacgagaccucccccaccacgaccaucaccaacaaccacccccagaacaacuucaccaacaucacgaacaucaucgugagcaagaacgaggaggagaacuuccugaaccugaccaagccccucugcgaggucaacuccuggcacauccugagcaaggacaacgcgauccgcaucggcgagaacgcccacauccuggugacccgggagccguaccucuccugcgacccccaggggugccgcauguucgcccugagccagggcaccacgcugcggggccagcacgccaacgggaccauccacgaccgcucccccuuccgggcccucaucagcugggagaugggccaggcgcccuccccguacaacgcccgcguggagugcaucggguggagcuccaccagcugccacgacggcaucucccggaugagcaucugcaucuccgggcccaacaacaacgccagcgccgucgugugguacggcggccgccccgugaccgagauccccagcugggcggggaacauccugcggacgcaggaguccgagugcgucugccacggcgggaucugcccgguggugaugaccgacggccccgccaacaaccgcgccgagaccaagaucaucuacuucaaggagggcaagauccagaagaucgaggagcugaaggggaacgcccagcacaucgaggagugcagcugcuacggcgccuccgggaugaucaagugcaucugccgggacaacuggaagggcgcgaaccgccccgucaucaccaucgaccccgagaugaugacgcacaccagcaaguaccucugcuccaagauccugaccgacaccagccggccgaacgaccccacgaacgggaacugcgacgcccccaucaccggcggcucccccgacccgggggugaagggcuucgccuuccuggacggggagaacagcuggcucggccgcaccaucuccaaggacagccgguccggguacgagaugcugaaggugcccaacgccgagaccgacacgcagagcggcgccaucucccaccagaugaucgucaacaaccagaacuggagcggcuacuccggggcguucaucgacuacugggccaacaaggagugcuucaaccccugcuucuacguggagcugauccgcggccggcccaaggagagcuccgugcucuggaccagcaacuccaucgucgcccugugcgggagccgcgagcggcugggcagcugguccuggcacgacggggccgagaucaucuacuucaaguga

SEQ ID NO: 85440 - RNA, 1413 nt, Artificial Sequence
  derived and/or modified sequence opt1 from neuraminidase__InfluenzaA__AHJ57900
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccgcgacgaucaucaacaaccacccccagaacaacuucaccaacaucaccaacaucaucgugaacaagaacgaggaggagaacuucuucaaccuggccaagccccucugcgaggucaacagcuggcacauccuguccaaggacaacgccauccgcaucggcgagaacgcccacauccuggugacccgggagccguaccucagcugcgacccccaggggugccgcauguucgcccugucccagggcacgacccugcggggccagcacgcgaacgggaccauccacgaccgcagccccuuccgggcccucaucuccugggagaugggccaggcccccagcccguacaacgcccgcguggagugcaucgggugguccagcaccuccugccacgacggcaucagccggauguccaucugcaucagcgggcccaacaacaacgcguccgccgucgugugguacggcggccgccccgugacggagauccccagcugggccgggaacauccugcggacccaggagagcgagugcgucugccacggcgggaucugcccgguggugaugaccgacggccccgccaacaaccgcgccgagaccaagaucaucuacuucaaggagggcaagauccagaagaucgaggaccugaaggggaacgcgcagcacaucgaggagugcuccugcuacggcgccagcgggaugaucaagugcaucugccgggacaacuggaagggcgccaaccgccccgucaucacgaucgaccccgagaugaugacccacaccuccaaguaccucugcagcaagauccugaccgacacgucccggccgaacgaccccaccaacgggaacugcgacgcccccaucaccggcggcagccccgacccgggggugaagggcuucgccuuccuggacggggagaacuccuggcucggccgcaccaucagcaaggacucccggagcggguacgagaugcugaaggugcccaacgcggagacggacacccaguccggcgccaucagccaccagaugaucgucaacaaccagaacugguccggcuacagcggggccuucaucgacuacugggccaacaaggagugcuucaaccccugcuucuacguggagcugauccgcggccggcccaaggaguccagcgugcucuggaccuccaacagcaucgucgcccugugcgggucccgcgagcggcugggcagcuggagcuggcacgacggggcggagaucaucuacuucaaguga

SEQ ID NO: 85441 - RNA, 1413 nt, Artificial Sequence
  derived and/or modified sequence opt1 from neuraminidase__InfluenzaA__AHJ57911
augaaccccaaccagaagaucacgugcaucagcgccaccggcgugacccuguccgucgugagccuccugaucgggaucgccaaccugggccucaacaucgggcugcacuacaagguguccgacagcuccaacaucaacaucccgaacaugaacgagaccaaccccaccaccacgaucaucaacaaccacacccagaacaacuucaagaacaucaccaacaucaucgucaacaagaacgaggagggcaucuuccugaaccucaccaagccccugugcgaggugaacagcuggcacauccuguccaaggacaacgcgauccgcaucggggaggacgcccacauccucgugacgcgggagcccuaccugagcugcgacccgcagggcugccgcauguucgcccugucccagggcaccacccuccgggggcgccacgccaacggcaccauccacgaccggagccccuuccgcgcccugaucuccugggagauggggcaggcgcccagccccuacaacgcccgggucgagugcaucggcugguccagcacguccugccacgacgggaucagccgcauguccaucugcaucagcggcccgaacaacaacgccuccgccguggugugguaccggggccgccccgucaccgagauccccagcugggcggggaacauccugcggacccaggagagcgagugcgugugccacaagggcaucugccccguggucaugaccgacgggccggccaacaaccgcgccgccacgaagaucaucuacuucaaggagggcaagauccagaagaucgaggagcucaagggcaacgcccagcacaucgaggagugcuccugcuacggggcggccggcaugaucaagugcaucugccgggacaacuggcgcggggccaaccggcccgugaucaccaucgaccccgagaugaugacccacaccagcaaguaccugugcuccaagauccugacggacaccagccgccccaacgacccgaccaacggcaacugcgacgcccccaucaccgggggcucccccgaccccggcgugaagggguucgccuuccucgacggcgagaacagcuggcuggggcggacgaucuccaaggacagccgcuccggcuacgagaugcugaaggucccgaacgcggagaccgacacccagagcggguccaccagcuaccagaucaucgugaacaaccagaacugguccggcuacagcggcgccuucaucgacuacugggccaacaaggagugcuucaaccccugcuucuacguggagcucauccgggggcgccccaaggaguccagcguccuguggacguccaacagcaucguggcccugugcggcucccgggagcgccucgggagcuggagcuggcacgacggcgccgagaucaucuacuucaaguga

SEQ ID NO: 85442 - RNA, 1410 nt, Artificial Sequence
  derived and/or modified sequence opt1 from neuraminidase__InfluenzaA__AHJ57923
augaaccccaaccagaagaucaucaccgugggcagcgucucccuggccaucgccaccaucugcuuccucaugcagaucgcgauccuggccacgaccgugacccugcacuucaagcagaacgagugcaacaucccgagcaagaaccaggugaugcccugcgagcccaucaucaucgagcgcaacaucaccgaggucguguaccucaacaacacgaucaucgagaaggagaucugccccaagguggucgaguaccggaacugguccaagccgcagugccagaucaccggguucgcccccuucagcaaggacaacuccauccgccugagcgccggcggggacaucugggugacccgggagcccuacguguccugcagccccuccaagugcuaccaguucgcccugggccaggggaccacgcucgacaacagccacuccaacggcaccauccacgaccgcaucccgcaccggacccugcugaugaacgagcucggcguccccuuccaccuggggaccaagcaggucugcaucgcguggagcuccagcuccugccacgacggccgcgccuggcugcacgugugcaucacgggggacgaccggaacgccaccgccagcuucaucuacaacggcaugcucguggacuccaucagcuccuggagccgcaacauccugcggacccaggagagcgagugcgugugcaucaacgggaccugcacggugaucaugaccgacggcuccgcgagcggcgucgccgacacccgcauccuguucauccgggaggggaagaucgugcacgugagcccccucuccggcuccgcccagcacaucgaggagugcagcugcuacccccgcuacccggacguccggugcgugugccgcgacaacuggaagggguccaaccggcccguggucgacaucaacauggccgacuacagcaucgacucccacuacgugugcagcggccuggugggcgacacgccccgcaacgacgacuccagcuccagcuccaacugcaaggaccccaacaacgagcgggggaacccgggcgucaaggggugggccuucgacgacggcaacgacguguggauggggcgcaccaucagccgggacucccgcagcggcuacgagaccuuccgggucaucggcggguggaccaccgcgaacuccaagagccagaucaaccgccaggugaucguggacaacaacaacuggagcggcuacuccggggucuucagcguggagggcaaguccugcaucaaccgcugcuucuacguggagcugauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 85443 - RNA, 1380 nt, Artificial Sequence
  derived and/or modified sequence opt1 from neuraminidase__InfluenzaA__AHJ57935
augaaccccaaccagaagaucacgugcaucagcgccaccggcgugacccuguccgucgugagccuccugaucgggaucgccaaccugggccucaacaucgggcugcacuacaagguguccgacagcccgaccaucaacauccccaacaugaacgagaccaaccccaccacgaccaacaucaccaacaucaucgucaacaagaacgaggagggcaccuuccugaaccucacgaagccccugugcgaggugaacuccuggcacauccugagcaaggacaacgcgauccgcaucggggaggacgcccacauccucgugacccgggagccguaccuguccugcgacccccagggcugccgcauguucgcccugagccagggcaccacccuccgggggcgccacgccaacggcacgauccacgaccggucccccuuccgcgcccugaucagcugggagauggggcaggcgcccuccccguacaacacccgggucgagugcaucggcuggagcuccaccagcugccacgacgggaucucccgcaugagcaucugcaucuccggccccaacaacaacgccagcgccguggugugguaccggggccgccccgucaccgagauccccuccugggccgggaacauccugcggacgcaggagagcgagugcgugugccacaagggcaucugcccgguggucaugaccgacgggcccgcgaacaacaaggccgccaccaagaucaucuacuucaaggagggcaagauccagaagaucgaggagcuccagggcaacgcccagcacaucgaggagugcagcugcuacggggccgcgggcaugaucaagugcgugugccgcgacaacuggaagggggccaaccggcccaucaucaccaucgaccccgagaugaugacgcacaccuccaaguaccugugcagcaagauccugaccgacaccucccgcccgaacgaccccacgaacggcaacugcgacgcccccaucaccgggggcagccccgacccgggcgugaagggguucgccuuccucgacggcgagaacuccuggcuggggcggaccaucagcaaggacucccgcagcggcuacgagaugcugaagguccccaacgcccagaccgacacgcaguccgggcccaccagcuaccagcucaucgugaacaaccagaacugguccggcuacagcggcgcguucaucgacuacugggccaacaaggagugcuucaaccccugcuucuacguggagcugauccgggggcgcccgaaggaguccaacguccuguggaccagcaacuccaugguggcccucugcggcagccgggagcgccugggguccuggagcuggcacgacgacgccgagaucaucuacuucaaguga

SEQ ID NO: 85444 - RNA, 1410 nt, Artificial Sequence
  derived and/or modified sequence opt1 from neuraminidase__InfluenzaA__AHJ57946
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccguggugaugaccgacggcagcgccagcggggucgcggacacgcggauccucuucauccgcgagggcaagaucgugcacaucagcccccuguccggcuccgcccagcacaucgaggagugcagcugcuacccccgguaccccgacgugcgcugcgucugccgggacaacuggaagggguccaaccgcccggugaucgacaucaacauggccgacuacagcaucgacucccacuacgugugcagcggccuggucggggacacgccccggaacgacgacaacuccagcuccagcaacugccgcgaccccaacaacgagcggggcaaccccggggugaagggcugggccuucgacgacggcaacgacguguggauggggcgcaccaucaaccgggacucccgcagcggcuacgagaccuuccgggucaucgggggcuggaccaccgccaacuccaagagccagaucaaccgccaggugaucgucgacaacaacaacugguccggguacagcggcguguucuccguggagggcaagagcugcaucaaccgcugcuucuacgucgagcucauccgggggcgcccgcaggagccccgggugugguggaccagcaacuccaucguggucuucugcggcaccagcgggacguacggcaccggguccuggcccgacggcgcgaacaucaacuucaugcccaucuga

SEQ ID NO: 85445 - RNA, 1410 nt, Artificial Sequence
  derived and/or modified sequence opt1 from neuraminidase__InfluenzaA__AHJ57957
augaaccccaaccagaagaucaucaccaucggcagcgugucccugaccaucgccacggucagcuuccucaugcagaucgccauccugaccaccaccgugacgcugcacuucaagcagaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccguggugaugaccgacggcagcgccagcggggucgcggacacgcggauccucuucauccgcgagggcaagaucgugcacaucagcccccuguccggcuccgcccagcacaucgaggagugcagcugcuacccccgguaccccgacgugcgcugcgucugccgggacaacuggaagggguccaaccgcccggugaucgacaucaacauggccgacuacagcaucgacuccaacuacgugugcagcggccuggucggggacacgccccggaacgacgacaacuccagcuccagcaacugccgcgaccccaacaacgagcggggcaaccccggggugaagggcugggccuucgacuacggcaacgacguguggauggggcgcaccaucaaccgggacucccgcagcggcuacgagaccuuccgggucaucgggggcuggaccaccgccaacuccaagagccagaucaaccgccaggugaucgucgacaacaacaacugguccggguacagcggcguguucuccguggagggcaagagcugcaucaaccgcugcuucuacgucgagcucauccgggggcgcccgcaggagccccgggugugguggaccagcaacuccaucguggucuucugcggcaccagcgggacguacggcaccggguccuggcccgacggcgcgaacaucaacuucaugcccaucuga

SEQ ID NO: 85446 - RNA, 1410 nt, Artificial Sequence
  derived and/or modified sequence opt1 from neuraminidase__InfluenzaA__AHJ57968
augaaccccaaccagaagaucaucaccgugggcagcgucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucagcaaggacaacuccauccgccugagcgccggcggggacaucugggugacccgggagcccuacguguccugcagccccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggagcuccagcuccugccacgacggccgcgccuggcuccacgugugcaucacgggggacgaccggaacgccaccgccagcuucaucuacaacggcaugcugguggacuccaucagcuccuggagccgcaacauccugcggacccaggagagcgagugcgugugcaucaacgggaccugcacggugaucaugaccgacggcuccgcgagcggcgucgccgacacccgcauccucuucauccgggaggggaagaucgugcacaucagcccccuguccggcuccgcccagcacaucgaggagugcagcugcuacccccgcuacccggacgugcggugcgucugccgcgacaacuggaagggguccaaccggcccgugaucgacaucaacauggccgacuacagcaucgacuccaacuacgugugcagcggccuggucggcgacacgccccgcaacgacgacaacuccagcuccagcaacugccgggaccccaacaacgagcgcgggaacccgggcgugaaggggugggccuucgacgacggcaacgacguguggauggggcggaccaucaaccgcgacucccggagcggcuacgagaccuuccgcgucaucggcggguggaccaccgcgaacuccaagagccagaucaaccgccaggugaucgucgacaacaacaacugguccggcuacagcgggguguucagcguggagggcaaguccugcaucaaccggugcuucuacgucgagcucauccgcgggcggccccaggagacgcgcgugugguggaccagcaacuccaucguggucuucugcggcaccagcugcaccuacggcacgggguccuggcccgacggcgccaacaucaacuucaugcccaucuga

SEQ ID NO: 85447 - RNA, 1413 nt, Artificial Sequence
  derived and/or modified sequence opt1 from neuraminidase__InfluenzaA__AHJ57980
augaaccccaaccagaagaacacgugcaucagcgccaucggcaugacccuguccguggucagccuccugaucgggguggccgaccugggccucaacaucgggcugcacuacaagguguccgacagcuccaacaucaacaucccgaacaugaacgagaccaaccccaccaccaccaucaucaacaacaacccccagaacaacuucacgaacaucaccaacaucaucgucaacaagaacgaggaggagaaguuccugaaccucaccaagccccugugcgaggugaacagcuggcacauccuguccaaggacaacgcgauccgcaucggcgaggacgcccacauccucgugacccgggagccguaccugagcugcgacccccaggggugccgcauguucgcccugucccagggcacgacccuccggggccgccacgccaacgggaccauccacgaccggagccccuuccgcgcccugaucuccugggagaugggccaggcgcccagcccguacaacgcccgggucgagugcaucgggugguccagcaccuccugccacgacggcaucagccgcauguccaucugcaucagcgggcccaacaacaacgccuccgccguggugugguacggcggccggcccgucacggagauccccagcugggcggggaacauccugcgcacccaggagagcgagugcgugugccacaagggcaucugcccgguggucaugaccgacgggcccgccaacaaccgggccgccaccaagaucaucuacuucaaggagggcaagauccagaagaucgaggagcucaagggcaacgcccagcacaucgaggagugcuccugcuacggggcggccggcaugaucaagugcaucugccgcgacaacuggaagggggccaaccggcccgugaucacgaucgaccccgagaugaugacccacaccagcaaguaccugugcuccaagauccugaccgacacgagccgcccgaacgaccccaccuccggcaacugcgacgcccccaucaccgggggcagccccgacccgggcgugaagggguucgccuuccucgacggcgagaacuccuggcuggggcggaccaucagcaaggacucccgcagcggcuacgagaugcugaagguccccaacgcggagacggacacccaguccgggcccaucagcuaccagaccaucgugaacaaccagaacugguccggcuacagcggcgccuucaucgacuacugggccaacaaggagugcuucaaccccugcuucuacguggagcucauccgggggcgcccgaaggaguccagcguccuguggaccuccaacagcaucguggcccugugcggcucccgggagcgccucgggagcuggagcuggcacgacggcgccgagaucaucuacuucaaguga

SEQ ID NO: 85448 - RNA, 1410 nt, Artificial Sequence
  derived and/or modified sequence opt1 from neuraminidase__InfluenzaA__AHJ57992
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccguggugaugaccgacggcagcgccagcggggucgcggacacgcggauccucuucauccgcgagggcaagaucgugcacaucagcccccuguccggcuccgcccagcacaucgaggagugcagcugcuacccccgguaccccgacgugcgcugcgucugccgggacaacuggaagggguccaaccgcccggugaucaacaucaacauggccgacuacagcaucgacuccaacuacgugugcagcggccuggucggggacacgccccggaacgacgacaacuccagcuccagcaacugccgcgaccccaacaacgagcggggcaaccccggggugaagggcugggccuucgacgacggcaacgacguguggauggggcgcaccaucaaccgggacucccgcagcggcuacgagaccuuccgggucaucgggggcuggaccaccgccaacuccaagagccagaucaaccgccaggugaucgucgacaacaacaacugguccggguacagcggcguguucuccguggagggcaagagcugcaucaaccgcugcuucuacgucgagcucauccgggggcgcccgcaggagccccgggugugguggaccagcaacuccaucguggucuucugcggcaccagcgggacguacggcaccggguccuggcccgacggcgcgaacaucaacuucaugcccaucuga

SEQ ID NO: 85449 - RNA, 1413 nt, Artificial Sequence
  derived and/or modified sequence opt1 from neuraminidase__InfluenzaA__AHJ58004
augaaccccaaccagaagaucacgugcaucagcgccaccggcgugacgcuguccgucgugagccuccugaucgggaucgccaaccugggccucaacaucgggcugcacuacaagguguccgacagcuccaacaucaacaucccgaacaugaacgagaccaaccccaccaccacgaucaucaacaaccacacccagaacaacuucaagaacaucaccaacaucaucgucaacaagaacgaggagggcaccuuccugaaccucacgaagccccugugcgaggugaacagcuggcacauccuguccaaggacaacgcgauccgcaucggggaggacgcccacauccucgugacccgggagcccuaccugagcugcgacccgcagggcugccgcauguucgcccugucccagggcaccacccuccgggggcgccacgccaacggcacgauccacgaccggagccccuuccgcgcccugaucuccugggagauggggcaggcgcccagccccuacaacgcccgggucgagugcaucggcugguccagcaccuccugccacgacgggaucagccgcauguccaucugcaucagcggcccgaacaacaacgccuccgccguggugugguaccggggccgccccgucaccgagauccccagcugggcggggaacauccugcggacccaggagagcgagugcgugugccacaagggcaucugccccguggucaugacggacgggccggccaacaaccgcgccgccaccaagaucaucuacuucaaggagggcaagauccagaagaucgaggagcucaagggcaacgcccagcacaucgaggagugcuccugcuacggggcggccggcaugaucaagugcaucugccgggacaacuggcgcggggccaaccggcccgugaucaccaucgaccccgagaugaugacccacacgagcaaguaccugugcuccaagauccugaccgacaccagccgccccaacgacccgaccaacggcaacugcgacgagcccaucaccgggggcucccccgaccccggcgugaagggguucgccuuccucgacggcgagaacagcuggcuggggcggaccaucuccaaggacagccgcuccggcuacgagaugcugaaggucccgaacgccgagaccgacacccagagcgggcccacguccuaccagaucaucgugaacaaccagaacuggagcggcuacuccggcgcguucaucgacuacugggccaacaaggagugcuucaaccccugcuucuacguggagcucauccgggggcgccccaaggagagcuccguccuguggaccagcaacuccaucguggcccugugcggcagccgggagcgccucggguccuggagcuggcacgacggcgccgagaucaucuacuucaaguga

SEQ ID NO: 85450 - RNA, 1413 nt, Artificial Sequence
  derived and/or modified sequence opt1 from neuraminidase__InfluenzaA__AHJ58016
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaagaugaacgagaccaaccccaccacgaccaucaucaacaaccacccccagaacaacuucaccaacaucaccaacaucaucgugaacaagaacgaggaggagaacuuccugaaccugacgaagccccucugcgaggucaacuccuggcacauccugagcaaggacaacgcgauccgcaucggcgagaacgcccacauccuggugacccgggagccguaccucuccugcgacccccaggggugccgcauguucgcccugagccagggcaccacccugcggggccgccacgccaacgggacgauccacgaccggucccccuuccgcgcccucaucagcugggagaugggccaggcgcccuccccguacaacgcccggguggagugcaucggguggagcuccaccagcugccacgacggcaucucccgcaugagcaucugcaucuccgggcccaacaacaacgccagcgccgucgugugguacggcggccggcccgugaccgagauccccuccugggcggggaacauccugcgcacccaggagagcgagugcgucugccacggcgggaucugcccgguggugaugacggacggccccgccaacaaccgggccgagaccaagaucaucuacuucaaggagggcaagauccagaagaucgaggagcugaaggggaacgcccagcacaucgaggagugcagcugcuacggcgccuccgggaugaucaagugcaucugccgcgacaacuggaagggcgcgaaccggcccgucaucaccaucgaccccgagaugaugacccacacgagcaaguaccucugcuccaagauccugaccgacaccagccgcccgaacgaccccaccaacgggaacugcgacgcccccaucacgggcggcucccccgacccgggggugaagggcuucgccuuccuggacgggaagaacagcuggcucggccggaccaucuccaaggacagccgcuccggguacgagaugcugaaggugcccaacgccgagaccgacacccagagcggcgccaucucccaccagaucaucgucaacaaccagaacuggagcggcuacuccggggcguucaucgacuacugggccaacaaggagugcuucaaccccugcuucuacguggagcugauccggggccgccccaaggagagcuccgugcucuggacgagcaacuccaucgucgcccugugcgggagccgggagcgccugggcuccuggagcuggcacgacggggccgagaucaucuaccucaaguga

SEQ ID NO: 85451 - RNA, 1413 nt, Artificial Sequence
  derived and/or modified sequence opt1 from neuraminidase__InfluenzaA__AHJ58028
augaaccccaaccagaagaucacgugcaucagcgccaccggcaugacccuguccguggucagcaugcucaucgggaucgccaaccugggccugaacaucgggcuccacuacaagguguccgacagcaccaacaucaacaucccgaagaugaacgagaccaaccccaccacgaccaucaucaacaaccacccccagaacaacuucaccaacaucaccaacaucaucgugaacaagaacgaggaggagaacuuccugaaccugacgaagccccucugcgaggucaacuccuggcacauccugagcaaggacaacgcggugcgcaucggcgaggacgcccacauccuggugacccgggagccguaccucuccugcgacccccaggggugccgcauguucgcccugagccagggcaccacccugcggggccgccacgccaacgggacgauccacgaccggucccccuuccgcgcccucaucagcugggagaugggccaggcgcccuccccguacaacacccgggucgagugcaucggguggagcuccaccagcugccacgacggcaucucccgcaugagcaucugcaucuccgggcccaacaacaacgccagcgccguggugugguaccggggccgccccgucaccgagauccccuccugggccggcaacauccugcggacgcaggagagcgagugcgugugccacaaggggaucugcccgguggucaugaccgacggccccgcgaacaaccgcgccgagaccaagaucaucuacuucaaggaggggaagauccagaagaucgaggagcuggagggcaacgcccagcacaucgaggagugcagcugcuacggcaccgccgggaugaucaagugcaucugccgggacaacuggcgcggcgccaaccggcccgugaucacgaucgaccccgagaugaugacccacaccucccgcuaccucugcagcaagauccugaccgacacgucccggccgaacgaccccaccaacgggaacugcgacgcgcccaucaccggcgggagccccgacccgggcgugaagggcuucgccuuccuggacgggaagaacuccuggcucggccgcaccaucagcaaggacucccggagcggguacgagaugcugaagguccccaacgccgagacggacauccaguccggccccaccagcaaccagaucaucgugaacaaccagaacugguccggguacagcggcgccuucaucgacuacugggccaacaaggagugcuucaaccccugcuucuacguggagcugauccgcggccggccgaaggaguccaacguccucuggaccagcaacuccaucguggcgcugugcgggagccgcgagcgccugggcuccuggagcuggcacgacggggccgagaucaucuacuucaaguga

SEQ ID NO: 85452 - RNA, 1410 nt, Artificial Sequence
  derived and/or modified sequence opt1 from neuraminidase__InfluenzaA__AHJ58040
augaaccccaaccagaagaucaucaccgugggcagcgucucccuggccaucgccaccaucugccuccugaugcagaucgcgauccuggccacgaccgugacccuccacuucaagcagaacgagugcaacaucccgagcaagaaccaggugaugcccugcgagcccaucaucaucgagcgcaacaucaccgaggucguguaccugaacaacacgaucaucgagaaggagaucugccccaagguggucgaguaccggaacugguccaagccgcagugccagaucaccggguucgcccccuucagcaaggacaacuccauccgccugagcgccggcggggacaucugggugacccgggagcccuacguguccugcagccccuccaagugcuaccaguucgcccucggccaggggaccacgcuggacaacagccacuccaacggcaccauccacgaccgcaucccgcaccggacccugcucaugaacgagcugggcguccccuuccaccuggggaccaagcaggucugcaucgcguggagcuccagcuccugccacgacggccgcgccuggcuccacgugugcaucacgggggacgaccggaacgccaccgccagcuucaucuacaacggcaugcugguggacuccaucagcuccuggagccgcaacauccugcggacccaggagagcgagugcgugugcaucaacgggaccugcacggugaucaugaccgacggcuccgcgagcggcgucgccgacacccgcauccucuucauccgggaggggaagaucgugcacgugagcccccuguccggcuccgcccagcacaucgaggagugcagcugcuacccccgcuacccggacguccggugcgugugccgcgacaacuggaagggguccaaccggcccguggucgacaucaacauggccgacuacagcaucgacucccacuacgugugcagcggccuggugggcgacacgccccgcaacgacgacuccagcuccagcuccaacugcaaggaccccaacaacgagcgggggaacccgggcgucaaggggugggccuucgacgacggcaacgacguguggauggggcgcaccaucagccgggacucccgcagcggcuacgagaccuuccgggucaucggcggguggaccaccgcgaacuccaagagccagaucaaccgccaggugaucguggacaacaacaacuggagcggcuacuccggggucuucagcguggagggcaaguccugcaucaaccgcugcuucuacguggagcucauccgggggcgcccccaggagacgcgggucugguggaccagcaacuccaucgugguguucugcggcaccagcggcaccuacgggacgggcuccuggcccgacggggccaacaucaacuucaugcccaucuga

SEQ ID NO: 85453 - RNA, 1410 nt, Artificial Sequence
  derived and/or modified sequence opt1 from neuraminidase__InfluenzaA__AHJ58052
augaaccccaaccagaagaucaucaccaucggcagcgugucccugaccaucgccacggucagcuuccucaugcagaucgccauccugaccaccaccgugacgcugcacuucaagcacaacgagugcaacaugccgcccaagaaccaggugauguccugcgagcccaucaucaucgagcgcaacaucaccgagaucgucuaccucaacaacaccaccguggagaaggagaucugccccaagguggucgaguaccggaacuggagcaagccgcagugcaagaucacgggguucgcgcccuucuccaaggacaacagcauccgccuguccgccggcggggacaucugggugacccgggagcccuacgugagcugcggccuggggaagugcuaccaguucgcccucggccagggcaccacccuggacaacucccacagcaacgggacgauccacgaccgcaucccccaccggacccugcucaugaacgagcugggcgucccguuccaccuggggaccaagcaggucugcaucgccugguccagcuccagcugccacgacggccgcgccuggcuccacaucugcaucaccggggacgaccggaacgcgacggccuccuucaucuacgacggcaugcugguggacagcaucggcuccuggagcaagaacauccugcgcacccaggaguccgagugcgugugcaucaacgggaccugcgccguggugaugaccgacggcagcgccagcggggucgcggacacgcggauccucuucauccgcgagggcaagaucgugcacaucagcccccuguccggcuccgcccagcacaucgaggagugcagcugcuacccccgguaccccgacgugcgcugcgucugccgggacaacuggaagggguccaaccgcccggugaucgacaucaacauggccgacuacagcaucgacuccaacuacgugugcagcggccuggucggggacacgccccggaacgacgacaacuccagcuccagcaacugccgcgaccccaacaacgagcggggcaaccccggggugaagggcugggccuucgacgacggcaacgacguguggauggggcgcaccaucaaccgggacucccgcagcggcuacgagaccuuccgggucaucgggggcuggaccaccgccaacuccaagagccagaucaaccgccaggugaucgucgacaacaacaacugguccggguacagcggcguguucuccguggagggcaagagcugcaucaaccgcugcuucuacgucgagcucauccgggggcgcccgcaggagccccgggugugguggaccagcaacuccaucguggucuucugcggcaccagcgggacguacggcaccggguccuggcccgacggcgcgaacaucaacuucaugcccaucuga

SEQ ID NO: 85454 - RNA, 1413 nt, Artificial Sequence
  derived and/or modified sequence opt1 from neuraminidase__InfluenzaA__AHJ58064
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccacgaccaucaucaacaaccacccccagaacaacuucaccaacaucaccaacaucaucgugaacaagaacgaggaggagaacuuccugaaccucacgaagccccugugcgaggucaacagcuggcacauccuguccaaggacaacgcgauccgcaucggcgagaacgcccacauccucgugacccgggagccguaccugagcugcgacccccaggggugccgcauguucgcccugucccagggcaccacccuccggggccagcacgccaacgggacgauccacgaccgcagccccuuccgggcccugaucuccugggagaugggccaggcgcccagcccguacaacgcccgcguggagugcaucgggugguccagcaccuccugccacgacggcaucagccggauguccaucugcaucagcgggcccaacaacaacgccuccgccgucgugugguacggcggccgccccgugaccgagauccccagcugggcggggaacauccugcggacccaggagagcgagugcgucugccacggcgggaucugcccgguggugaugacggacggccccgccaacaaccgcgccgagaccaagaucaucuacuucaaggagggcaagauccagaagaucgaggagcucaaggggaacgcccagcacaucgaggagugcuccugcuacggcgccagcgggaugaucaagugcaucugccgggacaacuggaagggcgcgaaccgccccgucaucaccaucgaccccgagaugaugacccacacguccaaguaccugugcagcaagauccugaccgacaccucccggccgaacgaccccaucaacgggaacugcgacgcccccaucaccggcggcagccccgacccgggggugaagggcuucgccuuccucgacggggagaacuccuggcugggccgcacgaucagcaaggacucccggagcggguacgagaugcugaaggugcccaacgccgagaccgacacccaguccggcgccaucagccaccagaugaucgucaacaaccagaacugguccggcuacagcggggcguucaucgacuacugggccaacaaggagugcuucaaccccugcuucuacguggagcucauccgcggccggcccaaggaguccagcgugcuguggaccuccaacagcaucgucgcccugugcgggucccgcgagcggcucggcagcuggagcuggcacgacggggccgagaucaucuacuucaaguga

SEQ ID NO: 85455 - RNA, 1401 nt, Artificial Sequence
  derived and/or modified sequence opt1 from neuraminidase__InfluenzaA__AHJ58075
augaaccccaaccagaagaucaucgccaucggcagcgugucccugaccaucgccaucaucugcuuccuccugcagaucgcgauccugaccacgaccaugacccuccacuuccgccagaacgagugcagcaacccguccaacaaccaggucgugcccugcgagcccaucaucaucgagcggaacaccgugcaccugaacagcacgaccaucgagaaggagaucugccccaaggucgccgaguacaagaacugguccaagccgcagugccagaucaccggguucgcccccuucagcaaggacaacuccauccgccugagcgccggcggggacaucugggugacccgggagcccuacguguccugcagccucggcaagugcuaccaguucgcccuggggcagggcacgacccugaagaacaagcacuccaacggcaccacccacgaccgcaucccccaccggacgcuccugaugaacgagcugggggucccguuccaccucggcaccaagcaggucugcaucgcguggagcuccagcuccugccacgacgggaaggccuggcugcacaucugcgugaccggcgacgacaagaacgccaccgccagcaucaucuacgacgggaugcugguggacuccaucggcagcugguccaagaacauccuccgcacgcaggagagcgagugcgugugcaucaacgggaccugcgcgguggucaugaccgacgggagcgccuccggcaaggccgacacccggauccuguucauccgcgaggggaagaucaucaacaucagcccccuguccggcagcgcccagcacguggaggagugcuccugcuacccccgguaccccgaggugcgcugcgucugccgggacaacuggaagggcagcaaccgcccggugcucuacaucaacauggccgacuacuccaucgagagcuccuacgugugcagcgggcuggucggcgacacgccccgggacgacgacuccagcuccagcuccaacugccgcgaccccaacaacgagcggggcgcgcccggcgugaaggggugggccuucgacgacggcaacgacaucuggaugggccgcaccaucaagagcgacucccggagcggguacgagaccuuccgcguggucaacggcuggaccacggccaacuccaagagccagaucaaccgccaggugaucguggacagcgacuccuggagcggguacuccggcaucuucagcgucgaggggaagaacugcaucaaccggugcuucuacguggagcugauccggggccgcccgcaggagacccgcgucugguggaccuccaacagcaucaucguguucugcggcaccuccgggacguacggcaccgggagcuggcccgacggcgccaacaucaacuucaugcccaucuga

SEQ ID NO: 85456 - RNA, 1413 nt, Artificial Sequence
  derived and/or modified sequence opt1 from neuraminidase__InfluenzaA__AHJ58087
augaaccccaaccagaagaucacgugcaucagcgccaccggcaugacccuguccguggucagccuccugaucgggaucgccaaccugggccucaacaucgggcugcacuacaagguguccgacagcaccaacaucaacaucccgaacaugaacgagaccucccccaccacgaccaucaucaacaaccacccccagaacaacuucaccaacaucaccaacaucaucgugaacaagaacgaggaggagaacuuccugaaccucacgaagccccugugcgaggucaacagcuggcacauccuguccaaggacaacgcgauccgcaucggcgagaacgcccacauccucgugacccgggagccguaccugagcugcgacccccaggggugccgcauguucgcccugucccagggcaccacccuccggggccagcacgccaacgggacgauccacgaccgcagccccuuccgggcccugaucuccugggagaugggccaggcgcccagcccguacaacgcccgcguggagugcaucgggugguccagcaccuccugccacgacggcaucagccggauguccaucugcaucagcgggcccaacaacaacgccuccgccgucgugugguacggcggccgccccgugaccgagauccccagcugggcggggaacauccugcggacccaggagagcgagugcgucugccacggcgggaucugcccgguggugaugacggacggccccgccaacaaccgcgccgagaccaagaucaucuacuucaaggagggcaagauccagaagaucgaggagcucaaggggaacgcccagcacaucgaggagugcuccugcuacggcgccagcgggaugaucaagugcaucugccgggacaacuggaagggcgcgaaccgccccgucaucaccaucgaccccgagaugaugacccacacguccaaguaccugugcagcaagauccugaccgacaccucccggccgaacgaccccaucaacgggaacugcgacgcccccaucaccggcggcagccccgacccgggggugaagggcuucgccuuccucgacggggacaacuccuggcugggccgcacgaucagcaaggacucccggagcggguacgagaugcugaaggugcccaacgccgagaccgacacccaguccggcgccaucagccaccagaugaucgucaacaaccagaacugguccggcuacagcggggcguucaucgacuacugggccaacaaggagugcuucaaccccugcuucuacguggagcucauccgcggccggcccaaggaguccagcgugcuguggaccuccaacagcaucgucgcccugugcgggucccgcgagcggcucggcagcuggagcuggcacgacggggccgagaucaucuacuucaaguga

SEQ ID NO: 85457 - RNA, 1410 nt, Artificial Sequence
  derived and/or modified sequence opt1 from neuraminidase__InfluenzaA__AHL80721
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaagggcuucgagaugaucugggaccccaacggguggaccggcaccgacaacaacuucagcaucaagcaggacgugguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 85458 - RNA, 1410 nt, Artificial Sequence
  derived and/or modified sequence opt1 from neuraminidase__InfluenzaA__AHL80732
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 85459 - RNA, 1410 nt, Artificial Sequence; identical to SEQ ID NO: 77746
  derived and/or modified sequence opt1 from neuraminidase__InfluenzaA__AHL80743

SEQ ID NO: 85460 - RNA, 1410 nt, Artificial Sequence
  derived and/or modified sequence opt1 from neuraminidase__InfluenzaA__AHL80754
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 85461 - RNA, 1410 nt, Artificial Sequence; identical to SEQ ID NO: 77746
  derived and/or modified sequence opt1 from neuraminidase__InfluenzaA__AHL80765

SEQ ID NO: 85462 - RNA, 1410 nt, Artificial Sequence; identical to SEQ ID NO: 77746
  derived and/or modified sequence opt1 from neuraminidase__InfluenzaA__AHL80776

SEQ ID NO: 85463 - RNA, 1410 nt, Artificial Sequence; identical to SEQ ID NO: 77746
  derived and/or modified sequence opt1 from neuraminidase__InfluenzaA__AHL80787

SEQ ID NO: 85464 - RNA, 1410 nt, Artificial Sequence
  derived and/or modified sequence opt1 from neuraminidase__InfluenzaA__AHL80798
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcgugaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 85465 - RNA, 1410 nt, Artificial Sequence; identical to SEQ ID NO: 77746
  derived and/or modified sequence opt1 from neuraminidase__InfluenzaA__AHL80809

SEQ ID NO: 85466 - RNA, 1410 nt, Artificial Sequence; identical to SEQ ID NO: 77746
  derived and/or modified sequence opt1 from neuraminidase__InfluenzaA__AHL80820

SEQ ID NO: 85467 - RNA, 1410 nt, Artificial Sequence; identical to SEQ ID NO: 77746
  derived and/or modified sequence opt1 from neuraminidase__InfluenzaA__AHL80831

SEQ ID NO: 85468 - RNA, 1410 nt, Artificial Sequence; identical to SEQ ID NO: 77746
  derived and/or modified sequence opt1 from neuraminidase__InfluenzaA__AHL80842

SEQ ID NO: 85469 - RNA, 1410 nt, Artificial Sequence; identical to SEQ ID NO: 79034
  derived and/or modified sequence opt1 from neuraminidase__InfluenzaA__AHL80853

SEQ ID NO: 85470 - RNA, 1410 nt, Artificial Sequence
  derived and/or modified sequence opt1 from neuraminidase__InfluenzaA__AHL80864
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 85471 - RNA, 1410 nt, Artificial Sequence; identical to SEQ ID NO: 79034
  derived and/or modified sequence opt1 from neuraminidase__InfluenzaA__AHL80875

SEQ ID NO: 85472 - RNA, 1410 nt, Artificial Sequence; identical to SEQ ID NO: 79034
  derived and/or modified sequence opt1 from neuraminidase__InfluenzaA__AHL80886

SEQ ID NO: 85473 - RNA, 1410 nt, Artificial Sequence
  derived and/or modified sequence opt1 from neuraminidase__InfluenzaA__AHL80897
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaagggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 85474 - RNA, 1410 nt, Artificial Sequence
  derived and/or modified sequence opt1 from neuraminidase__InfluenzaA__AHL80908
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaccauccacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 85475 - RNA, 1410 nt, Artificial Sequence
  derived and/or modified sequence opt1 from neuraminidase__InfluenzaA__AHL80919
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaccggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucgucgggaucaacgaguggagcggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 85476 - RNA, 1410 nt, Artificial Sequence; identical to SEQ ID NO: 80526
  derived and/or modified sequence opt1 from neuraminidase__InfluenzaA__AHL80930

SEQ ID NO: 85477 - RNA, 1410 nt, Artificial Sequence; identical to SEQ ID NO: 80526
  derived and/or modified sequence opt1 from neuraminidase__InfluenzaA__AHL80949

SEQ ID NO: 85478 - RNA, 1410 nt, Artificial Sequence
  derived and/or modified sequence opt1 from neuraminidase__InfluenzaA__AHL80961
augaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucagcaucaagcaggacgucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 85479 - RNA, 1410 nt, Artificial Sequence; identical to SEQ ID NO: 85478
  derived and/or modified sequence opt1 from neuraminidase__InfluenzaA__AHL80972

SEQ ID NO: 85480 - RNA, 1410 nt, Artificial Sequence; identical to SEQ ID NO: 80526
  derived and/or modified sequence opt1 from neuraminidase__InfluenzaA__AHL80983

SEQ ID NO: 85481 - RNA, 1410 nt, Artificial Sequence; identical to SEQ ID NO: 80526
  derived and/or modified sequence opt1 from neuraminidase__InfluenzaA__AHL80992

SEQ ID NO: 85482 - RNA, 1410 nt, Artificial Sequence; identical to SEQ ID NO: 80526
  derived and/or modified sequence opt1 from neuraminidase__InfluenzaA__AHL81004

SEQ ID NO: 85483 - RNA, 1410 nt, Artificial Sequence
  derived and/or modified sequence opt1 from neuraminidase__InfluenzaA__AHL81016
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgacuccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacagcguggucuccuggagcaaggagauccugcgcacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgguaccccggcguccgcugcgugugccgggacaacuggaagggguccaaccgccccaucguggacaucaacaucaaggaccacagcaucgucuccagcuacgugugcuccggccuggugggcgacaccccgcggaagaacgacagcuccagcuccagccacugccucgaccccaacaacgaggagggcgggcacggggucaagggcugggccuucgacgacgggaacgacguguggaugggccgcaccaucaacgagacgucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcacguccgggaccuacggcaccgggagcuggcccgacggcgccgaccugaaccucaugccgaucuga

SEQ ID NO: 85484 - RNA, 1410 nt, Artificial Sequence; identical to SEQ ID NO: 80526
  derived and/or modified sequence opt1 from neuraminidase__InfluenzaA__AHL81028

SEQ ID NO: 85485 - RNA, 1410 nt, Artificial Sequence; identical to SEQ ID NO: 80526
  derived and/or modified sequence opt1 from neuraminidase__InfluenzaA__AHL81040

SEQ ID NO: 85486 - RNA, 1410 nt, Artificial Sequence; identical to SEQ ID NO: 80526
  derived and/or modified sequence opt1 from neuraminidase__InfluenzaA__AHL81052

SEQ ID NO: 85487 - RNA, 1410 nt, Artificial Sequence; identical to SEQ ID NO: 85478
  derived and/or modified sequence opt1 from neuraminidase__InfluenzaA__AHL81064

SEQ ID NO: 85488 - RNA, 1410 nt, Artificial Sequence; identical to SEQ ID NO: 85478
  derived and/or modified sequence opt1 from neuraminidase__InfluenzaA__AHL81075

SEQ ID NO: 85489 - RNA, 1410 nt, Artificial Sequence
  derived and/or modified sequence opt1 from neuraminidase__InfluenzaA__AHL81086
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagagcaagcugcagaucaaccgccaggugaucguggaccggggcaaccgcuccggguacagcggcaucuucuccgucgagggcaagagcugcaucaaccggugcuucuacguggagcucauccgcgggcggaaggaggagaccgaggugcuguggaccagcaacuccaucgucguguucugcggcacgagcgggaccuacggcaccggguccuggccggacggcgccgaccugaaccucaugcccaucuga

SEQ ID NO: 85490 - RNA, 1410 nt, Artificial Sequence
  derived and/or modified sequence opt1 from neuraminidase__InfluenzaA__AHL81098
augaaccccaaccagaagaucaucaccaucggcagcgugucccugaccaucagcacgaucugcuucuucguccagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccgucgugagcugguccaaggagauccugcgcacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgguaccccggcgugcgcugcgugugccgggacaacuggaaggggagcaaccgcccgaucgucgacaucaacaucaaggaccacuccaucgugagcuccuacgugugcagcggccuggucggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggugaucgucgaccggggcaaccgcuccggguacagcggcaucuucuccguggagggcaagagcugcaucaaccggugcuucuacguggagcucauccgcgggcggaaggaggagaccgagguccuguggaccagcaacuccaucgugguguucugcggcacgagcgggaccuacggcaccggguccuggccggacggcgccgaccugaaccucaugcccaucuga

SEQ ID NO: 85491 - RNA, 1410 nt, Artificial Sequence; identical to SEQ ID NO: 81717
  derived and/or modified sequence opt1 from neuraminidase__InfluenzaA__AHL81110

SEQ ID NO: 85492 - RNA, 1410 nt, Artificial Sequence; identical to SEQ ID NO: 81717
  derived and/or modified sequence opt1 from neuraminidase__InfluenzaA__AHL81121

SEQ ID NO: 85493 - RNA, 1410 nt, Artificial Sequence; identical to SEQ ID NO: 80526
  derived and/or modified sequence opt1 from neuraminidase__InfluenzaA__AHL81132

SEQ ID NO: 85494 - RNA, 1410 nt, Artificial Sequence; identical to SEQ ID NO: 80526
  derived and/or modified sequence opt1 from neuraminidase__InfluenzaA__AHL81144

SEQ ID NO: 85495 - RNA, 1410 nt, Artificial Sequence; identical to SEQ ID NO: 80526
  derived and/or modified sequence opt1 from neuraminidase__InfluenzaA__AHL81156

SEQ ID NO: 85496 - RNA, 1410 nt, Artificial Sequence; identical to SEQ ID NO: 82795
  derived and/or modified sequence opt1 from neuraminidase__InfluenzaA__AHL81168

SEQ ID NO: 85497 - RNA, 1410 nt, Artificial Sequence; identical to SEQ ID NO: 82795
  derived and/or modified sequence opt1 from neuraminidase__InfluenzaA__AHL81180

SEQ ID NO: 85498 - RNA, 1410 nt, Artificial Sequence; identical to SEQ ID NO: 80526
  derived and/or modified sequence opt1 from neuraminidase__InfluenzaA__AHL81192

SEQ ID NO: 85499 - RNA, 1410 nt, Artificial Sequence
  derived and/or modified sequence opt1 from neuraminidase__InfluenzaA__AHL81215
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucauguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggugacccgggagcccuacgucagcugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucaacgagaccagccggcugggcuacgagaccuucaaggugaucgaggggugguccaaccccaagagcaagcugcagaucaaccgccaggucaucguggaccggggcaaccgcuccggguacagcggcaucuucuccguggagggcaagagcugcaucaaccggugcuucuacgucgagcucauccgcgggcggaaggaggagaccgaggugcuguggaccagcaacuccaucguggucuucugcggcacgagcgggaccuacggcaccggguccuggccggacggcgccgaccugaacuucaugcccaucuga

SEQ ID NO: 85500 - RNA, 1410 nt, Artificial Sequence
  derived and/or modified sequence opt1 from neuraminidase__InfluenzaA__AHL81227
augaaccccaaccagaagaucaucaccaucggcagcgugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaccggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcacggacaacaacuucuccaucaagcaggacaucaucgggaucaacgaguggagcggcuacuccgggagcuucguccagcacccggagcugaccggccuggacugcauccgccccugcuucuggguggagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 85501 - RNA, 1410 nt, Artificial Sequence; identical to SEQ ID NO: 80526
  derived and/or modified sequence opt1 from neuraminidase__InfluenzaA__AHL81238

SEQ ID NO: 85502 - RNA, 1410 nt, Artificial Sequence; identical to SEQ ID NO: 80526
  derived and/or modified sequence opt1 from neuraminidase__InfluenzaA__AHL81250

SEQ ID NO: 85503 - RNA, 1410 nt, Artificial Sequence; identical to SEQ ID NO: 80526
  derived and/or modified sequence opt1 from neuraminidase__InfluenzaA__AHL81262

SEQ ID NO: 85504 - RNA, 1410 nt, Artificial Sequence; identical to SEQ ID NO: 80526
  derived and/or modified sequence opt1 from neuraminidase__InfluenzaA__AHL81274

SEQ ID NO: 85505 - RNA, 1410 nt, Artificial Sequence; identical to SEQ ID NO: 80526
  derived and/or modified sequence opt1 from neuraminidase__InfluenzaA__AHL81286

SEQ ID NO: 85506 - RNA, 1410 nt, Artificial Sequence; identical to SEQ ID NO: 80526
  derived and/or modified sequence opt1 from neuraminidase__InfluenzaA__AHL81298

SEQ ID NO: 85507 - RNA, 1410 nt, Artificial Sequence; identical to SEQ ID NO: 85478
  derived and/or modified sequence opt1 from neuraminidase__InfluenzaA__AHL81310

SEQ ID NO: 85508 - RNA, 1410 nt, Artificial Sequence; identical to SEQ ID NO: 81717
  derived and/or modified sequence opt1 from neuraminidase__InfluenzaA__AHL81332

SEQ ID NO: 85509 - RNA, 1410 nt, Artificial Sequence
  derived and/or modified sequence opt1 from neuraminidase__InfluenzaA__AHL81343
augaaccccaaccagaagaucaucaccaucggcagcgugucccugaccaucagcacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccguggucagcugguccaaggagauccuccgcacccaggagagcgagugcgugugcaucaacggcacgugcaccguggucaucaccgacggguccgccagcggcaaggccgacaccaagauccuguucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccucgugggcgacacgccccggaagaacgacuccagcuccagcucccacugcagcgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagagcaagcugcagaucaaccgccaggugaucguggaccggggcaaccgcuccggguacagcggcaucuucagcgucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 85510 - RNA, 1410 nt, Artificial Sequence; identical to SEQ ID NO: 80526
  derived and/or modified sequence opt1 from neuraminidase__InfluenzaA__AHL81355

SEQ ID NO: 85511 - RNA, 1410 nt, Artificial Sequence; identical to SEQ ID NO: 81717
  derived and/or modified sequence opt1 from neuraminidase__InfluenzaA__AHL81367

SEQ ID NO: 85512 - RNA, 1410 nt, Artificial Sequence; identical to SEQ ID NO: 81717
  derived and/or modified sequence opt1 from neuraminidase__InfluenzaA__AHL81378

SEQ ID NO: 85513 - RNA, 1410 nt, Artificial Sequence; identical to SEQ ID NO: 81717
  derived and/or modified sequence opt1 from neuraminidase__InfluenzaA__AHL81389

SEQ ID NO: 85514 - RNA, 1410 nt, Artificial Sequence; identical to SEQ ID NO: 80526
  derived and/or modified sequence opt1 from neuraminidase__InfluenzaA__AHL81400

SEQ ID NO: 85515 - RNA, 1410 nt, Artificial Sequence; identical to SEQ ID NO: 85499
  derived and/or modified sequence opt1 from neuraminidase__InfluenzaA__AHL81412

SEQ ID NO: 85516 - RNA, 1410 nt, Artificial Sequence; identical to SEQ ID NO: 77746
  derived and/or modified sequence opt1 from neuraminidase__InfluenzaA__AHL81422

SEQ ID NO: 85517 - RNA, 1410 nt, Artificial Sequence; identical to SEQ ID NO: 79034
  derived and/or modified sequence opt1 from neuraminidase__InfluenzaA__AHL81433

SEQ ID NO: 85518 - RNA, 1410 nt, Artificial Sequence
  derived and/or modified sequence opt1 from neuraminidase__InfluenzaA__AHL88954
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucaaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccgggacaaccggagcggcuacuccgggaucuucagcgucgagggcaagagcugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 85519 - RNA, 1410 nt, Artificial Sequence
  derived and/or modified sequence opt1 from neuraminidase__InfluenzaA__AHL89033
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgaggacaagagcugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 85520 - RNA, 1410 nt, Artificial Sequence
  derived and/or modified sequence opt1 from neuraminidase__InfluenzaA__AHL89045
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgccaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaccaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 85521 - RNA, 1410 nt, Artificial Sequence
  derived and/or modified sequence opt1 from neuraminidase__InfluenzaA__AHL89057
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaagcccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 85522 - RNA, 1410 nt, Artificial Sequence; identical to SEQ ID NO: 76715
  derived and/or modified sequence opt1 from neuraminidase__InfluenzaA__AHL89069

SEQ ID NO: 85523 - RNA, 1410 nt, Artificial Sequence; identical to SEQ ID NO: 75720
  derived and/or modified sequence opt1 from neuraminidase__InfluenzaA__AHL89081

SEQ ID NO: 85524 - RNA, 1410 nt, Artificial Sequence; identical to SEQ ID NO: 75720
  derived and/or modified sequence opt1 from neuraminidase__InfluenzaA__AHL89093

SEQ ID NO: 85525 - RNA, 1410 nt, Artificial Sequence; identical to SEQ ID NO: 75720
  derived and/or modified sequence opt1 from neuraminidase__InfluenzaA__AHL89117

SEQ ID NO: 85526 - RNA, 1410 nt, Artificial Sequence; identical to SEQ ID NO: 75720
  derived and/or modified sequence opt1 from neuraminidase__InfluenzaA__AHL89129

SEQ ID NO: 85527 - RNA, 1410 nt, Artificial Sequence
  derived and/or modified sequence opt1 from neuraminidase__InfluenzaA__AHL89141
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 85528 - RNA, 1410 nt, Artificial Sequence
  derived and/or modified sequence opt1 from neuraminidase__InfluenzaA__AHL89153
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucucccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgccaccgcguccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcccagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggcguucgacgacgggaacgacguguggaugggccggaccaucuccgagaagcugcgcagcggcuacgagaccuucaaggucaucgaggggugguccaaccccaacagcaagcugcagaucaaccgccaggugaucguggaccggggcaaccgguccggguacagcggcaucuucagcgucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 85529 - RNA, 1410 nt, Artificial Sequence; identical to SEQ ID NO: 75720
  derived and/or modified sequence opt1 from neuraminidase__InfluenzaA__AHL89165

SEQ ID NO: 85530 - RNA, 1410 nt, Artificial Sequence
  derived and/or modified sequence opt1 from neuraminidase__InfluenzaA__AHL89177
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaacgagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggagcggguacuccggcaucuucagcgucgagggcaagagcugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 85531 - RNA, 1410 nt, Artificial Sequence; identical to SEQ ID NO: 77572
  derived and/or modified sequence opt1 from neuraminidase__InfluenzaA__AHL89189

SEQ ID NO: 85532 - RNA, 1410 nt, Artificial Sequence; identical to SEQ ID NO: 76715
  derived and/or modified sequence opt1 from neuraminidase__InfluenzaA__AHL89201

SEQ ID NO: 85533 - RNA, 1410 nt, Artificial Sequence; identical to SEQ ID NO: 77572
  derived and/or modified sequence opt1 from neuraminidase__InfluenzaA__AHL89213

SEQ ID NO: 85534 - RNA, 1410 nt, Artificial Sequence
  derived and/or modified sequence opt1 from neuraminidase__InfluenzaA__AHL89225
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucagcaaggacaacuccauccgccugagcgccggcggggacaucugggucacccgggagcccuacguguccugcgacccggacaagugcuaccaguucgcccucggccaggggaccacgcugaacaacgugcacagcaacgacaccguccacgaccgcacccccuaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccuccggcaaggccgacaccaagauccucuucaucgaggagggcaagaucgugcacacgagcacccugagcggguccgcgcagcacguggaggagugcagcugcuacccccgcuacccgggcguccggugcgugugccgcgacaacuggaagggguccaaccggcccaucguggacaucaacaucaaggacuacagcaucgucuccagcuacgugugcuccggccuggugggcgacacgccccgcaagaacgacagcuccagcuccagccacugccucgaccccaacaacgaggagggcgggcacggggucaagggcugggccuucgacgacgggaacgacguguggaugggccggaccaucuccgagaagcugcgccugggcuacgagaccuucaaggucaucgagggguggagcaacccgaacuccaagcuccagaccaaccgccaggugaucguggaccggggcaaccggagcggguacuccggcaucuucagcgucgaggggaaguccugcaucaaccgcugcuucuacguggagcugauccggggccgcaaggaggagaccgaggugcuguggaccagcaacagcaucgucguguucugcggcacguccgggaccuacggcaccgggagcuggcccgacggcgccgacaucaaccucaugcccaucuga

SEQ ID NO: 85535 - RNA, 1410 nt, Artificial Sequence; identical to SEQ ID NO: 77572
  derived and/or modified sequence opt1 from neuraminidase__InfluenzaA__AHL89237

SEQ ID NO: 85536 - RNA, 1410 nt, Artificial Sequence; identical to SEQ ID NO: 76715
  derived and/or modified sequence opt1 from neuraminidase__InfluenzaA__AHL89261

SEQ ID NO: 85537 - RNA, 1410 nt, Artificial Sequence
  derived and/or modified sequence opt1 from neuraminidase__InfluenzaA__AHL89273
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggaccggggcaaccgguccggguacagcggcaucuucuccgucgagggcaagagcugcaucaaccgcugcuucuacguggagcugauccgggggcgcaaggaggagaccgacgugcuguggaccagcaacuccaucgucguguucugcggcacgagcgggaccuacggcaccggguccuggccggacggcgccgacaucaaccucaugcccaucuga

SEQ ID NO: 85538 - RNA, 1410 nt, Artificial Sequence
  derived and/or modified sequence opt1 from neuraminidase__InfluenzaA__AHL89285
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggaccggggcaaccgguccggguacagcggcaucuucuccgucgagggcaagagcugcaucaaccgcugcuucuacguggagcugauccgggggcgcaaggaggagaccgacgugcuguggaccagcaacuccaucgucguguucugcagcacguccggcaccuacgggaccggcagcuggccggacggggccgacaucaaccucaugcccaucuga

SEQ ID NO: 85539 - RNA, 1410 nt, Artificial Sequence; identical to SEQ ID NO: 85537
  derived and/or modified sequence opt1 from neuraminidase__InfluenzaA__AHL89297

SEQ ID NO: 85540 - RNA, 1410 nt, Artificial Sequence; identical to SEQ ID NO: 85537
  derived and/or modified sequence opt1 from neuraminidase__InfluenzaA__AHL89309

SEQ ID NO: 85541 - RNA, 1410 nt, Artificial Sequence
  derived and/or modified sequence opt1 from neuraminidase__InfluenzaA__AHL89321
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacaucagcacgcuguccgggagcgcgcagcacgucgaggagugcuccugcuacccccgcuaccccggcgugcggugcgugugccgcgacaacuggaaggggagcaaccggccgaucgucgacaucaacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcaccagcgggacguacggcaccggguccuggccggacggcgccgacaucaaccucaugcccaucuga

SEQ ID NO: 85542 - RNA, 1410 nt, Artificial Sequence
  derived and/or modified sequence opt1 from neuraminidase__InfluenzaA__AHL89333
augaaccccaaccagaagaucaucaccaucggcagcgugucccugaccaucagcacgaucugcuucuucaugcagaucgccauccucaucgccaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcaacaucacgggguucgcccccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccagcuccugccacgacgggaaggcguggcuccacgugugcgugacgggcgacgacaagaacgccaccgccagcuucaucuacaacgggcgccugguggacuccaucgucagcugguccaaggagauccugcggacccaggagagcgagugcgugugcaucaacgggaccugcgccguggucaugacggacggguccgcgagcggcaaggccgacaccaagauccucuucaucgaggagggcaagaucgugcacaccagcacccuguccgggagcgcccagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcggccacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggaccggggcaaccgguccggguacagcggcaucuucuccgucgagggcaagagcugcaucaaccgcugcuucuacguggagcugauccgggggcgcaaggaggagacggaggugcuguggaccagcaacuccaucgucguguucugcggcaccagcgggaccuacggcacgggguccuggccggacggcgccgacaucaaccucaugcccaucuga

SEQ ID NO: 85543 - RNA, 1410 nt, Artificial Sequence; identical to SEQ ID NO: 75720
  derived and/or modified sequence opt1 from neuraminidase__InfluenzaA__AHL89345

SEQ ID NO: 85544 - RNA, 1410 nt, Artificial Sequence; identical to SEQ ID NO: 76714
  derived and/or modified sequence opt1 from neuraminidase__InfluenzaA__AHL89357

SEQ ID NO: 85545 - RNA, 1410 nt, Artificial Sequence; identical to SEQ ID NO: 76715
  derived and/or modified sequence opt1 from neuraminidase__InfluenzaA__AHL89369

SEQ ID NO: 85546 - RNA, 1410 nt, Artificial Sequence
  derived and/or modified sequence opt1 from neuraminidase__InfluenzaA__AHL89381
augaaccccaaccagaagaucaucaccaucggcagcgugucccugaccaucagcacgaucugcuucuucaugcagaucgccauccucaucaccaccgucacccugcacuucaagcaguacgaguacaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccaucgucagcugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcagcggccuggugggcgacacgccccgcaagaacgacuccagcuccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacagcaagcuccagaccaaccgccaggugaucguggaccggggcaaccgguccggguacagcggcaucuucuccgucgagggcaagagcugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 85547 - RNA, 1410 nt, Artificial Sequence; identical to SEQ ID NO: 85537
  derived and/or modified sequence opt1 from neuraminidase__InfluenzaA__AHL89405

SEQ ID NO: 85548 - RNA, 1410 nt, Artificial Sequence
  derived and/or modified sequence opt1 from neuraminidase__InfluenzaA__AHL89417
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccagcuucaucuacaacgggcgccugguggacuccgucgugagcugguccaaggacauccugcggacccaggagagcgagugcgugugcaucaacggcacgugcaccgucgugaugaccgacggguccgccagcggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggagcaaccggccgaucgucgacaucgacaucaagaacuacuccaucgugagcuccuacgugugcagcggccuggucggcgacacgccccgcaagaccgacuccagcuccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagagcugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 85549 - RNA, 1410 nt, Artificial Sequence; identical to SEQ ID NO: 76715
  derived and/or modified sequence opt1 from neuraminidase__InfluenzaA__AHL89429

SEQ ID NO: 85550 - RNA, 1410 nt, Artificial Sequence; identical to SEQ ID NO: 75720
  derived and/or modified sequence opt1 from neuraminidase__InfluenzaA__AHL89441

SEQ ID NO: 85551 - RNA, 1410 nt, Artificial Sequence; identical to SEQ ID NO: 75720
  derived and/or modified sequence opt1 from neuraminidase__InfluenzaA__AHL89453

SEQ ID NO: 85552 - RNA, 1410 nt, Artificial Sequence
  derived and/or modified sequence opt1 from neuraminidase__InfluenzaA__AHL89465
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaagugccccaagcuggccgaguaccggaacuggagcaagccgcagugcaacaucacgggguucgcgcccuucuccaaggacaacagcauccgccuguccgccggcggggacaucugggucacccgggagcccuacgugagcugcgaccccgaccgcugcuaccaguucgcccucggccaggggaccacccugaacaacgugcacuccaacgacacgguccacgaccggaccccguaccgcacccugcucaugaacgagcugggcgugcccuuccaccugggcaccaagcaggucugcaucgccuggagcuccagcuccugccacgacgggaaggccuggcuccacgugugcgugacgggcgacgacaagaacgcgaccgccagcuucaucuacaacgggcggcugguggacuccaucgucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagcugcggcugggcuacgagaccuucaaggucaucgaggggugguccaaccccaacagcaagcuccagaccaaccgccaggugaucguggaccggggcaaccgcuccggguacagcggcaucuucuccgucgagggcaagagcugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 85553 - RNA, 1410 nt, Artificial Sequence; identical to SEQ ID NO: 85527
  derived and/or modified sequence opt1 from neuraminidase__InfluenzaA__AHL89477

SEQ ID NO: 85554 - RNA, 1410 nt, Artificial Sequence
  derived and/or modified sequence opt1 from neuraminidase__InfluenzaA__AHL89489
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcuccaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucuccagcuacgugugcuccggccuggugggcgacacgccccgcaagaacgaccggagcuccagcucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaacccccacagcaagcugcagaucaaccgccaggugaucguggaccggggcaaccgcuccggguacagcggcaucuucagcgucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 85555 - RNA, 1410 nt, Artificial Sequence; identical to SEQ ID NO: 76715
  derived and/or modified sequence opt1 from neuraminidase__InfluenzaA__AHL89501

SEQ ID NO: 85556 - RNA, 1410 nt, Artificial Sequence; identical to SEQ ID NO: 76715
  derived and/or modified sequence opt1 from neuraminidase__InfluenzaA__AHL89513

SEQ ID NO: 85557 - RNA, 1410 nt, Artificial Sequence; identical to SEQ ID NO: 76715
  derived and/or modified sequence opt1 from neuraminidase__InfluenzaA__AHL89525

SEQ ID NO: 85558 - RNA, 1410 nt, Artificial Sequence; identical to SEQ ID NO: 76715
  derived and/or modified sequence opt1 from neuraminidase__InfluenzaA__AHL89537

SEQ ID NO: 85559 - RNA, 1413 nt, Artificial Sequence
  derived and/or modified sequence opt1 from neuraminidase__InfluenzaA__AHL89549
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagcaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 85560 - RNA, 1413 nt, Artificial Sequence; identical to SEQ ID NO: 77038
  derived and/or modified sequence opt1 from neuraminidase__InfluenzaA__AHL89561

SEQ ID NO: 85561 - RNA, 1413 nt, Artificial Sequence; identical to SEQ ID NO: 77038
  derived and/or modified sequence opt1 from neuraminidase__InfluenzaA__AHL89573

SEQ ID NO: 85562 - RNA, 1413 nt, Artificial Sequence; identical to SEQ ID NO: 77073
  derived and/or modified sequence opt1 from neuraminidase__InfluenzaA__AHL89585

SEQ ID NO: 85563 - RNA, 1413 nt, Artificial Sequence
  derived and/or modified sequence opt1 from neuraminidase__InfluenzaA__AHL89597
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccguccgcgaccggagccccuaccgcgcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccaggugggcuacaucugcagcggcguguucggggacaacccccggcccaaggacggcaagggguccugcaacccgaugacggucgacggcgcggacggggugaagggcuucagcuacaaguacggcaacgggguguggaucggccgcaccaaguccaacaagcugcggaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 85564 - RNA, 1413 nt, Artificial Sequence; identical to SEQ ID NO: 77073
  derived and/or modified sequence opt1 from neuraminidase__InfluenzaA__AHL89609

SEQ ID NO: 85565 - RNA, 1413 nt, Artificial Sequence
  derived and/or modified sequence opt1 from neuraminidase__InfluenzaA__AHL89621
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccaccggaagggguucgagaugaucugggaccccaacggcuggaccgacaccgacuccgacuucagcgucaagcaggacgugguggccaucacggacuggagcggguacuccggcagcuucguccagcaccccgagcugaccggccucgacugcauccgccccugcuucuggguggagcugguccgggggcugccgcgcgagaacaccaccaucuggacguccggcagcuccaucagcuucugcgggguggacuccgacaccgccaacuggagcuggcccgacggcgccgagcuccccuucaccaucgacaaguga

SEQ ID NO: 85566 - RNA, 1413 nt, Artificial Sequence; identical to SEQ ID NO: 77064
  derived and/or modified sequence opt1 from neuraminidase__InfluenzaA__AHL89633

SEQ ID NO: 85567 - RNA, 1413 nt, Artificial Sequence; identical to SEQ ID NO: 77073
  derived and/or modified sequence opt1 from neuraminidase__InfluenzaA__AHL89645

SEQ ID NO: 85568 - RNA, 1413 nt, Artificial Sequence; identical to SEQ ID NO: 77038
  derived and/or modified sequence opt1 from neuraminidase__InfluenzaA__AHL89657

SEQ ID NO: 85569 - RNA, 1413 nt, Artificial Sequence
  derived and/or modified sequence opt1 from neuraminidase__InfluenzaA__AHL89669
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggucgacggcgcggacggggugaagggcuucagcuacaaguacggcaacgggguguggaucggccggaccaaguccaacgagcugcgcaagggguucgagaugaucugggaccccaacggcuggaccgacaccgacagcgacuucuccgucaagcaggacgugguggccaucacggacuggagcggguacagcggcuccuucguccagcaccccgagcucaccggccuggacugcauccggcccugcuucuggguggagcugguccgcgggcucccgcgggagaacaccaccaucuggacgagcggcuccagcaucuccuucugcgggguggacagcgacaccgccaacugguccuggcccgacggcgccgagcugcccuucaccaucgacaaguga

SEQ ID NO: 85570 - RNA, 1413 nt, Artificial Sequence
  derived and/or modified sequence opt1 from neuraminidase__InfluenzaA__AHL89681
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaagaucaccaagagcaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccaggucggcuacaucugcagcggcguguucggggacaacccccgccccaaggacggcaagggguccugcaacccgaugacgguggacggcgcggacggggucaagggcuucagcuacaaguacggcaacgggguguggaucggccggaccaaguccaacaagcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacgccaccaucuggaccagcggcuccagcaucuccuucugcggggucgacagcgacacggccaacugguccuggcccgacggcgccgagcugcccuucaccaucgacaaguga

SEQ ID NO: 85571 - RNA, 1413 nt, Artificial Sequence
  derived and/or modified sequence opt1 from neuraminidase__InfluenzaA__AHL89693
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaagggcaucaucacgggcaccaucaaguccuggcgcaagcagauccugcggacccaggagagcgagugcgugugcaugaacggguccugcuucaccaucaugacggacggccccagcaacggggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggcuacaucugcagcggggucuucggcgacaacccccgccccaaggacggggagggcuccugcaacccggugaccguggacggggcggacggcgucaagggcuucagcuacaaguacgacgacgggguguggaucggccggacgaaguccaaccgccugcggaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 85572 - RNA, 1413 nt, Artificial Sequence
  derived and/or modified sequence opt1 from neuraminidase__InfluenzaA__AHL89705
augaaccccaaccagaagaucaucaccaucggcagcaucuccaucgccaucgggaucaucagccugaugcuccagaucggcaacaucaucuccaucugggccagccacuccauccagaacgggagccagaaccacaccggcaucugcaaccagcgcaucaucacguacgagaacuccaccugggugaaccacaccuacgucagcaucaacaacaccaacgugguggcggggaaggacaagacguccgucacccuggccggcaacagcucccugugcagcaucuccggcugggccaucuacaccaaggacaacagcauccggaucggguccaagggcgacguguucgugauccgcgagccguucaucagcugcucccaccucgagugccggaccuucuuccugacgcagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucaccgagacgaucaagagcuggaagaagcgcauccugcggacccaggaguccgagugcgugugcgugaacggcagcugcuucaccaucaugaccgacgggcccuccaacggcgccgccagcuacaagaucuucaagaucgagaaggggaaggucacgaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagcgucaagcaggacgugguggccaucaccgacuggagcggguacuccggcagcuucguccagcaccccgagcucacgggccuggacugcauccgccccugcuucuggguggagcugguccgggggcucccgcgcgagaacaccaccaucuggaccuccggcagcuccaucagcuucugcgggguggacuccgacacggccaacuggagcuggcccgacggcgccgagcugcccuucaccaucgacaaguga

SEQ ID NO: 85573 - RNA, 1413 nt, Artificial Sequence; identical to SEQ ID NO: 77038
  derived and/or modified sequence opt1 from neuraminidase__InfluenzaA__AHL89717

SEQ ID NO: 85574 - RNA, 1413 nt, Artificial Sequence; identical to SEQ ID NO: 77038
  derived and/or modified sequence opt1 from neuraminidase__InfluenzaA__AHL89729

SEQ ID NO: 85575 - RNA, 1413 nt, Artificial Sequence
  derived and/or modified sequence opt1 from neuraminidase__InfluenzaA__AHL89753
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucagcaucaacaacacgaacgugguggcggggaacgacaagaccuccgucacccuggccggcaacagcucccugugcagcaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacagcaacggcaccgucaaggaccgcucccccuaccgggcccugaugagcugcccccugggggaggcgcccagcccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcagcuccaucagcuucugcgggguggacuccgacaccgccaacuggagcuggcccgacggcgccgagcugcccuucaccaucgacaaguga

SEQ ID NO: 85576 - RNA, 1413 nt, Artificial Sequence; identical to SEQ ID NO: 77038
  derived and/or modified sequence opt1 from neuraminidase__InfluenzaA__AHL89765

SEQ ID NO: 85577 - RNA, 1413 nt, Artificial Sequence; identical to SEQ ID NO: 77079
  derived and/or modified sequence opt1 from neuraminidase__InfluenzaA__AHL89777

SEQ ID NO: 85578 - RNA, 1413 nt, Artificial Sequence; identical to SEQ ID NO: 77038
  derived and/or modified sequence opt1 from neuraminidase__InfluenzaA__AHL89789

SEQ ID NO: 85579 - RNA, 1413 nt, Artificial Sequence
  derived and/or modified sequence opt1 from neuraminidase__InfluenzaA__AHL89801
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucgcccuggccggcaacuccagccugugcuccaucagcggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcagccccuaccgggcgcugauguccugcccccugggggaggcccccagcccguacaacagcaaguucgaguccguggccuggagcgccuccgcgugccacgacggcaugggcuggcucaccaucgggaucagcggccccgacaacggggccguggccguccugaaguacaacggcaucaucaccgagacgaucaaguccuggaagaagcgcauccugcggacccaggagagcgagugcgugugcgugaacggcuccugcuucaccaucaugaccgacgggcccagcaacggcgccgccuccuacaagaucuucaagaucgagaaggggaaggucaccaagagcaucgagcucaacgcgcccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucagcuacaaguacggcaacgggguguggaucggccggacgaaguccaaccgccugcggaagggguucgagaugaucugggaccccaacggcuggaccaacaccgacagcgacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccagcggcuccagcaucuccuucugcgggguggacagcgacacggccaacugguccuggcccgacggcgccgagcugcccuucaccaucgacaaguga

SEQ ID NO: 85580 - RNA, 1413 nt, Artificial Sequence
  derived and/or modified sequence opt1 from neuraminidase__InfluenzaA__AHL89813
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcagcggcguguucggggacaacccccgccccaaggacggcaagggguccugcaacccgaugacggcggacggcgccgacggggucaagggcuucagcuacaaguacggcaacgggguguggaucggccggaccaaguccaacaagcugcgcaagggguucgagaugaucugggaccccaacggcuggaccgacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacgccaccaucuggaccagcggcuccagcaucuccuucugcggggucgacagcgacacggccaacugguccuggcccgacggcgcggagcugcccuucaccaucgacaaguga

SEQ ID NO: 85581 - RNA, 1413 nt, Artificial Sequence; identical to SEQ ID NO: 77079
  derived and/or modified sequence opt1 from neuraminidase__InfluenzaA__AHL89825

SEQ ID NO: 85582 - RNA, 1413 nt, Artificial Sequence; identical to SEQ ID NO: 77038
  derived and/or modified sequence opt1 from neuraminidase__InfluenzaA__AHL89837

SEQ ID NO: 85583 - RNA, 1413 nt, Artificial Sequence
  derived and/or modified sequence opt1 from neuraminidase__InfluenzaA__AHL89849
augaaccccaaccagaagaucaucaccaucggcagcaucuccaucgccaucgggaucaucagccugaugcuccagaucggcaacaucaucuccaucugggccagccacuccauccagaccgggagccagaaccacacgggcaucugcaaccagcgcaucaucaccuacgagaacuccaccugggugaaccacaccuacgucuacaucaacaacacgaacgugguggcggggaaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccagcaacggcgccgccuccuacaagaucuucaagaucgagaaggggauggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcagcggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgagcggcuccagcaucuccuucugcgggguggacagcgacaccgccaacugguccuggcccgacggcgccgagcugcccuucaccaucgacaaguga

SEQ ID NO: 85584 - RNA, 1410 nt, Artificial Sequence; identical to SEQ ID NO: 77074
  derived and/or modified sequence opt1 from neuraminidase__InfluenzaA__AHL89861

SEQ ID NO: 85585 - RNA, 1410 nt, Artificial Sequence
  derived and/or modified sequence opt1 from neuraminidase__InfluenzaA__AHL89873
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggacggcgggaaccggagcggcuacuccgggaucuucagcguggagggcaagagcugcaucaaccgcugcuucuacgucgagcucauccggggccgcaaggaggagaccgaggugcuguggaccuccaacagcaucguggucuucugcgggacguccggcaccuacgggaccggcagcuggccggacggggccgacaucaaccugaugcccaucuga

SEQ ID NO: 85586 - RNA, 1410 nt, Artificial Sequence; identical to SEQ ID NO: 77751
  derived and/or modified sequence opt1 from neuraminidase__InfluenzaA__AHL89885

SEQ ID NO: 85587 - RNA, 1410 nt, Artificial Sequence
  derived and/or modified sequence opt1 from neuraminidase__InfluenzaA__AHL89897
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaccaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 85588 - RNA, 1410 nt, Artificial Sequence; identical to SEQ ID NO: 77410
  derived and/or modified sequence opt1 from neuraminidase__InfluenzaA__AHL89909

SEQ ID NO: 85589 - RNA, 1410 nt, Artificial Sequence; identical to SEQ ID NO: 77049
  derived and/or modified sequence opt1 from neuraminidase__InfluenzaA__AHL89921

SEQ ID NO: 85590 - RNA, 1410 nt, Artificial Sequence; identical to SEQ ID NO: 77410
  derived and/or modified sequence opt1 from neuraminidase__InfluenzaA__AHL89933

SEQ ID NO: 85591 - RNA, 1410 nt, Artificial Sequence; identical to SEQ ID NO: 77049
  derived and/or modified sequence opt1 from neuraminidase__InfluenzaA__AHL89945

SEQ ID NO: 85592 - RNA, 1410 nt, Artificial Sequence
  derived and/or modified sequence opt1 from neuraminidase__InfluenzaA__AHL89957
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacccaggagagcgagugcgucugcaucaacggcacgugcaccguggugaugaccgacggguccgccagcggcaaggccgacaccaagauccucuucaucaaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggaccggggcaaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 85593 - RNA, 1410 nt, Artificial Sequence; identical to SEQ ID NO: 76892
  derived and/or modified sequence opt1 from neuraminidase__InfluenzaA__AHL89969

SEQ ID NO: 85594 - RNA, 1410 nt, Artificial Sequence; identical to SEQ ID NO: 76892
  derived and/or modified sequence opt1 from neuraminidase__InfluenzaA__AHL89981

SEQ ID NO: 85595 - RNA, 1410 nt, Artificial Sequence
  derived and/or modified sequence opt1 from neuraminidase__InfluenzaA__AHL89993
augaaccccaaccagaagaucaucaccaucggcagcgugucccugagcaucuccaccaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagcuggccgaguaccggaacugguccaagccgcagugcgacaucacgggguucgcgcccuucagcaaggacaacuccauccgccugagcgccggcggggacaucugggucacccgggagcccuacguguccugcgaccccgacaagugcuaccaguucgcccucggccaggggaccacccugaacaacgugcacagcaacgacacgguccgcgaccggaccccguaccgcacccugcucaugaacgagcugggcgugcccuuccaccugggcaccaagcaggucugcaucgccugguccagcuccagcugccacgacgggaaggccuggcuccacgugugcaucacgggcgacgacaagaacgcgaccgccuccuucaucuacaacgggcggcugguggacagcaucguguccuggagcaaggagauccugcgcacccaggaguccgagugcgucugcaucaacgggaccugcacgcucgugaugaccgacgggagcgccagcggcaaggccgacaccaagauccuguucaucgaggagggcaagaucgugcacaccuccacgcugagcggguccgcgcagcacgucgaggagugcagcugcuacccccgguaccccggcgugcgcugcgugugccgggacaacuggaagggguccaaccgcccgaucgucgacaucaacaucaaggaccacagcaucguguccagcuacgugugcuccggccucgucggcgacacgccccggaagaacgacagcuccagcuccagccacugccuggaccccaacaacgaggagggcggccacggggugaagggcugggccuucgacgacgggaacgacguguggaugggccgcaccaucuccgagaagucccggcugggcuacgagaccuucaaggucaucgagggguggagcaaccccaagagcaagcuccagaucaaccgccaggugaucgucgaccggggcaaccgcuccggguacagcggcaucuucagcguggaggggaaguccugcaucaaccggugcuucuacguggagcugauccgcggccggaaggaggagaccgagguccuguggaccagcaacuccaucgugguguucugcggcaccagcgggaccuacggcacgggguccuggccggacggcgccgacaucaaccucaugcccaucuga

SEQ ID NO: 85596 - RNA, 1410 nt, Artificial Sequence
  derived and/or modified sequence opt1 from neuraminidase__InfluenzaA__AHL90005
augaaccccaaccagaagaucaucaccaucggcagcgugucccugaccaucagcacgaucugcuucuucaugcagaucgccauccucaucaccaccgucacccugcacuucaagcaguacgaguucuccagcccgcccaacaaccaggugaugcugugcgagcccacgaucaucaagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggagcgccagcggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccuacagcuccagccacugccucgaccccaacaacgaggagggcgggcacggggucaagggcugggccuucgacgacgggaacgacguguggaugggccgcaccaucuccgagaagucccggagcggcuacgagaccuucaaggucaucgagggguggagcaaccccaacuccaagcugcagaucaaccgccaggugaucguggaccggggcaaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 85597 - RNA, 1410 nt, Artificial Sequence; identical to SEQ ID NO: 77098
  derived and/or modified sequence opt1 from neuraminidase__InfluenzaA__AHL90017

SEQ ID NO: 85598 - RNA, 1410 nt, Artificial Sequence; identical to SEQ ID NO: 77049
  derived and/or modified sequence opt1 from neuraminidase__InfluenzaA__AHL90029

SEQ ID NO: 85599 - RNA, 1410 nt, Artificial Sequence; identical to SEQ ID NO: 77065
  derived and/or modified sequence opt1 from neuraminidase__InfluenzaA__AHL90041

SEQ ID NO: 85600 - RNA, 1410 nt, Artificial Sequence; identical to SEQ ID NO: 77065
  derived and/or modified sequence opt1 from neuraminidase__InfluenzaA__AHL90053

SEQ ID NO: 85601 - RNA, 1410 nt, Artificial Sequence; identical to SEQ ID NO: 83330
  derived and/or modified sequence opt1 from neuraminidase__InfluenzaA__AHL90065

SEQ ID NO: 85602 - RNA, 1410 nt, Artificial Sequence; identical to SEQ ID NO: 85592
  derived and/or modified sequence opt1 from neuraminidase__InfluenzaA__AHL90077

SEQ ID NO: 85603 - RNA, 1410 nt, Artificial Sequence; identical to SEQ ID NO: 77074
  derived and/or modified sequence opt1 from neuraminidase__InfluenzaA__AHL90089

SEQ ID NO: 85604 - RNA, 1410 nt, Artificial Sequence; identical to SEQ ID NO: 77751
  derived and/or modified sequence opt1 from neuraminidase__InfluenzaA__AHL90101

SEQ ID NO: 85605 - RNA, 1410 nt, Artificial Sequence; identical to SEQ ID NO: 77049
  derived and/or modified sequence opt1 from neuraminidase__InfluenzaA__AHL90113

SEQ ID NO: 85606 - RNA, 1413 nt, Artificial Sequence; identical to SEQ ID NO: 77640
  derived and/or modified sequence opt1 from neuraminidase__InfluenzaA__AHL90125

SEQ ID NO: 85607 - RNA, 1413 nt, Artificial Sequence
  derived and/or modified sequence opt1 from neuraminidase__InfluenzaA__AHL90136
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacagcggcauggucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcagcuccaucagcuucugcggggucaacuccgacaccgccaacuggagcuggcccgacggcgccgagcugcccuucacgaucgacaaguga

SEQ ID NO: 85608 - RNA, 1413 nt, Artificial Sequence; identical to SEQ ID NO: 77640
  derived and/or modified sequence opt1 from neuraminidase__InfluenzaA__AHL90160

SEQ ID NO: 85609 - RNA, 1413 nt, Artificial Sequence
  derived and/or modified sequence opt1 from neuraminidase__InfluenzaA__AHL90172
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgaggggaacugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacugguccggguacagcggcagcuucgugcagcaccccgagcucacgggccuggacugcauccggcccugcuucugggucgagcuggugcgcgggcucccgcgggagaacaccaccaucuggaccuccggcagcuccaucagcuucugcggggucaacuccgacacggccaacuggagcuggcccgacggcgccgagcugcccuucaccaucgacaaguga

SEQ ID NO: 85610 - RNA, 1413 nt, Artificial Sequence; identical to SEQ ID NO: 77640
  derived and/or modified sequence opt1 from neuraminidase__InfluenzaA__AHL90184

SEQ ID NO: 85611 - RNA, 1413 nt, Artificial Sequence; identical to SEQ ID NO: 80938
  derived and/or modified sequence opt1 from neuraminidase__InfluenzaA__AHL90196

SEQ ID NO: 85612 - RNA, 1413 nt, Artificial Sequence; identical to SEQ ID NO: 77640
  derived and/or modified sequence opt1 from neuraminidase__InfluenzaA__AHL90220

SEQ ID NO: 85613 - RNA, 1413 nt, Artificial Sequence
  derived and/or modified sequence opt1 from neuraminidase__InfluenzaA__AHL90232
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccagcggguccagcaucuccuucugcggcgucaacagcgacacggccaacugguccuggcccgacggggccgagcugcccuucaccaucgacaaguga

SEQ ID NO: 85614 - RNA, 1413 nt, Artificial Sequence
  derived and/or modified sequence opt1 from neuraminidase__InfluenzaA__AHL90244
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccgaugaccguggacggcgcgaacggggugaagggcuucagcuacaaguacgacaacggcgucuggaucgggcgcacgaaguccaaccggcugcgcaagggcuucgagaugaucugggaccccaacggguggaccaacaccgacagcgacuucuccgugaagcaggacguggucgccaucaccgacuggagcggcuacagcggguccuucgugcagcaccccgagcucacgggccuggacugcauccggcccugcuucuggguggagcugguccgcggccucccgcgggagaacaccaccaucuggaccagcggguccagcaucuccuucugcggcgugaacagcgacacggccuccuggagcuggcccgacggggccgagcugcccuucaccaucgacaaguga

SEQ ID NO: 85615 - RNA, 1413 nt, Artificial Sequence; identical to SEQ ID NO: 78469
  derived and/or modified sequence opt1 from neuraminidase__InfluenzaA__AHL90256

SEQ ID NO: 85616 - RNA, 1413 nt, Artificial Sequence
  derived and/or modified sequence opt1 from neuraminidase__InfluenzaA__AHL90268
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccagcaucgucaugugcgugugccgggacaacuggcacggcuccaaccgccccugggugagcuucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgaccgggacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccagcggcuccagcaucuccuucugcggggucaacagcgacacggccaacugguccuggcccgacggcgccgagcugcccuucaccaucgacaaguga

SEQ ID NO: 85617 - RNA, 1413 nt, Artificial Sequence; identical to SEQ ID NO: 78469
  derived and/or modified sequence opt1 from neuraminidase__InfluenzaA__AHL90280

SEQ ID NO: 85618 - RNA, 1413 nt, Artificial Sequence
  derived and/or modified sequence opt1 from neuraminidase__InfluenzaA__AHL90304
augaaccccaaccagaagaucaucaccaucggcagcaucuccaucgccaucgggaucaucagccugaugcuccagaucggcaacaucaucuccaucugggccagccacuccauccagaccgggagccagaacaacacggagaucugcaaccagcgcaucaucaccuacgagaacuccaccugggugaaccacaccuacgucaacaucaacaacacgaacgugguggcgggcgaggacaagaccagcgucacccuggccgggaacuccagccugugcuccaucagcggcugggccaucuacaccaaggacaacuccauccggaucggcagcaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccagcccguacaacagcaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccagcaacaaggccgccuccuacaagaucuucaagaucgagaagggcaaggugaccaagagcaucgagcucaacgcccccaacuuccacuacgaggagugcuccugcuacccggacaccgggaucgucaugugcgugugccgggacaacuggcacggcagcaaccgccccuggguguccuucaaccagaaccuggacuaccagaucggguacaucugcagcggcgucuucggcgacaacccccggcccgaggacggggagggcuccugcaacccggugaccguggacggggcgaacggcgucaagggguucagcuacaaguacgacaacggcguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacggggcuggacugcauccggcccugcuucugggucgagcuggugcgcggccucccgcgggagaacaccaccaucuggaccagcggcuccagcaucuccuucugcggggucaacagcgacacggccaacugguccuggcccgacggcgccgagcugcccuucaccaucgacaaguga

SEQ ID NO: 85619 - RNA, 1413 nt, Artificial Sequence; identical to SEQ ID NO: 77640
  derived and/or modified sequence opt1 from neuraminidase__InfluenzaA__AHL90316

SEQ ID NO: 85620 - RNA, 1413 nt, Artificial Sequence
  derived and/or modified sequence opt1 from neuraminidase__InfluenzaA__AHL90328
augaaccccaacaagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccgugaccgacuggagcggcuacagcggguccuucguccagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 85621 - RNA, 1413 nt, Artificial Sequence; identical to SEQ ID NO: 77640
  derived and/or modified sequence opt1 from neuraminidase__InfluenzaA__AHL90340

SEQ ID NO: 85622 - RNA, 1413 nt, Artificial Sequence
  derived and/or modified sequence opt1 from neuraminidase__InfluenzaA__AHL90352
augaaccccaaccagaagaucaugaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcagcccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacuggagcggcuacuccgggagcuucgugcagcaccccgagcucacgggccuggacugcauccggcccugcuucugggucgagcuggugcgcggcaugccgcgggagaacaccaccaucuggaccuccgggagcuccaucagcuucugcggcgucaacuccgacacggccaacuggagcuggcccgacggggccgagcuccccuucaccaucgacaaguga

SEQ ID NO: 85623 - RNA, 1413 nt, Artificial Sequence; identical to SEQ ID NO: 84469
  derived and/or modified sequence opt1 from neuraminidase__InfluenzaA__AHL90364

SEQ ID NO: 85624 - RNA, 1413 nt, Artificial Sequence; identical to SEQ ID NO: 78469
  derived and/or modified sequence opt1 from neuraminidase__InfluenzaA__AHL90376

SEQ ID NO: 85625 - RNA, 1410 nt, Artificial Sequence
  derived and/or modified sequence opt1 from neuraminidase__InfluenzaA__AHL90388
augaaccccaaccagaagaucaucaccaucggcagcgugucccugaucaucagcaccaucugcuucuucaugcagaucgccauccucaucacgaccgucacccugcacuucaagcaguacgaguucaacuccagcccgaacaaccaggugaugcugugcgagcccaccaucaucgagcgcaacaucacggagaucguguaccucaccaacaccaucaucgagaaggagaucugccccaagcuggccgaguaccggaacugguccaagccccagugcgacaucaccggguucgcgccguucagcaaggacaacuccauccgccugagcgccggcggggacaucugggucacgcgggagcccuacguguccugcgaccccgacaagugcuaccaguucgcccucggccaggggaccacccugaacaacgugcacagcaacaacaccguccgcgaccggacgcccuaccgcacccugcucaugaacgagcugggcgugccguuccaccugggcaccaagcaggucugcaucgccugguccagcuccagcugccacgacgggaaggccuggcuccacgugugcaucaccggcgacgacaagaacgcgacggccuccuucaucuacaacgggcggcugguggacagcaucguguccuggagcaaggagauccugcgcacccaggaguccgagugcgucugcaucaacgggaccugcaccguggugaugacggacgggagcgccagcggcaaggccgacaccaagauccucuucaucgaggagggcaagaucguccacaccuccacccugagcggguccgcgcagcacguggaggagugcagcugcuacccccgguaccccggcgugcgcugcgucugccgggacaacuggaagggguccaaccgccccaucguggacaucaacaucaaggaccacagcaucguguccagcuacgucugcuccggccuggugggcgacacgccgcggaagaacgacagcuccagcuccagccacugccucgaccccaacaacgaggagggcggccacggggugaagggcugggccuucgacgacgggaacgacgucuggaugggccgcaccaucuccgagaagucccggcugggcuacgagaccuucaaggugaucgagggguggagcaaccccaagagcaagcugcagaucaaccgccaggucaucguggaccggggcaaccgcuccggguacagcggcaucuucagcguggaggggaaguccugcaucaaccggugcuucuacgucgagcucauccgcggccggaaggaggagaccgaggugcuguggacgagcaacuccaucguggucuucugcggcaccagcgggaccuacggcaccggguccuggcccgacggcgccgacaucaaccugaugccgaucuga

SEQ ID NO: 85626 - RNA, 1410 nt, Artificial Sequence; identical to SEQ ID NO: 77520
  derived and/or modified sequence opt1 from neuraminidase__InfluenzaA__AHL90400

SEQ ID NO: 85627 - RNA, 1410 nt, Artificial Sequence; identical to SEQ ID NO: 77520
  derived and/or modified sequence opt1 from neuraminidase__InfluenzaA__AHL90413

SEQ ID NO: 85628 - RNA, 1410 nt, Artificial Sequence
  derived and/or modified sequence opt1 from neuraminidase__InfluenzaA__AHL90425
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcgccugguggacuccaucgugagcugguccaaggagauccugcggacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcggccacggggugaagggcugggccuucgacgacgggaacgacgucuggaugggccggaccaucagcgagaagucccgccugggcuacgagaccuucaaggugaucgagggguggagcaaccccaaguccaagcugcagaucaaccggcaggucaucguggaccgcggcgaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcacguccgggaccuacggcaccgggagcuggccggacggcgccgacaucaaccugaugcccaucuga

SEQ ID NO: 85629 - RNA, 1410 nt, Artificial Sequence; identical to SEQ ID NO: 77607
  derived and/or modified sequence opt1 from neuraminidase__InfluenzaA__AHL90437

SEQ ID NO: 85630 - RNA, 1410 nt, Artificial Sequence; identical to SEQ ID NO: 77520
  derived and/or modified sequence opt1 from neuraminidase__InfluenzaA__AHL90449

SEQ ID NO: 85631 - RNA, 1410 nt, Artificial Sequence; identical to SEQ ID NO: 77520
  derived and/or modified sequence opt1 from neuraminidase__InfluenzaA__AHL90461

SEQ ID NO: 85632 - RNA, 1410 nt, Artificial Sequence; identical to SEQ ID NO: 77520
  derived and/or modified sequence opt1 from neuraminidase__InfluenzaA__AHL90473

SEQ ID NO: 85633 - RNA, 1410 nt, Artificial Sequence; identical to SEQ ID NO: 77520
  derived and/or modified sequence opt1 from neuraminidase__InfluenzaA__AHL90485

SEQ ID NO: 85634 - RNA, 1410 nt, Artificial Sequence; identical to SEQ ID NO: 77611
  derived and/or modified sequence opt1 from neuraminidase__InfluenzaA__AHL90497

SEQ ID NO: 85635 - RNA, 1410 nt, Artificial Sequence; identical to SEQ ID NO: 77611
  derived and/or modified sequence opt1 from neuraminidase__InfluenzaA__AHL90509

SEQ ID NO: 85636 - RNA, 1410 nt, Artificial Sequence
  derived and/or modified sequence opt1 from neuraminidase__InfluenzaA__AHL90521
augaaccccaaccagaagaucaucaccaucggcagcgugucccugaccaucagcacgaucugcuucuuccuccagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacagcauccgccucuccgccggcggggacaucugggucacccgggagcccuacgugagcugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccagcuccugccacgacgggaaggccuggcugcacgugugcaucaccggcgacgacaagaacgcgaccgccagcuucaucuacaacgggcggcugguggacuccaucgugagcugguccaaggagauccuccgcacccaggagagcgagugcgucugcaucaacggcacgugcaccguggugaugaccgacggguccgccagcggcaaggccgacaccaagauccuguucaucgaggagggcaagaucguccacacgagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccucgugggcgacacgccccggaagaacgacuccagcuccagcucccacugccuggaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaaguccaagcuccagaucaaccgccaggucaucguggaccggggcaaccgcagcggguacuccggcaucuucagcguggagggcaagagcugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 85637 - RNA, 1410 nt, Artificial Sequence
  derived and/or modified sequence opt1 from neuraminidase__InfluenzaA__AHL90533
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccaucgugagcugguccaaggagauccugcgcacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcagcggccuggugggcgacacgccccggaagaacgacuccagcuccagcucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggagcaaccccaaguccaagcugcagaucaaccgccaggucaucguggagcggggcgaccgcagcggguacuccggcaucuucagcguggagggcaagagcugcaucaaccggugcuucuacgucgagcucauccgcgggcggaaggaggagaccgaggugcuguggaccuccaacagcaucguggucuucugcggcacguccgggaccuacggcaccgggagcuggccggacggcgccgacaucaaccugaugcccaucuga

SEQ ID NO: 85638 - RNA, 1410 nt, Artificial Sequence; identical to SEQ ID NO: 77520
  derived and/or modified sequence opt1 from neuraminidase__InfluenzaA__AHL90545

SEQ ID NO: 85639 - RNA, 1410 nt, Artificial Sequence; identical to SEQ ID NO: 77607
  derived and/or modified sequence opt1 from neuraminidase__InfluenzaA__AHL90557

SEQ ID NO: 85640 - RNA, 1410 nt, Artificial Sequence
  derived and/or modified sequence opt1 from neuraminidase__InfluenzaA__AHL90569
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaagggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacgggaccugcacgguggucaugaccgacggguccgccagcggcaaggccgacaccaagauccucuucaucgaggagggcaagaucgugcacaccagcacgcuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 85641 - RNA, 1410 nt, Artificial Sequence; identical to SEQ ID NO: 77607
  derived and/or modified sequence opt1 from neuraminidase__InfluenzaA__AHL90581

SEQ ID NO: 85642 - RNA, 1410 nt, Artificial Sequence; identical to SEQ ID NO: 77611
  derived and/or modified sequence opt1 from neuraminidase__InfluenzaA__AHL90593

SEQ ID NO: 85643 - RNA, 1410 nt, Artificial Sequence
  derived and/or modified sequence opt1 from neuraminidase__InfluenzaA__AHL90605
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 85644 - RNA, 1410 nt, Artificial Sequence; identical to SEQ ID NO: 77607
  derived and/or modified sequence opt1 from neuraminidase__InfluenzaA__AHL90629

SEQ ID NO: 85645 - RNA, 1410 nt, Artificial Sequence; identical to SEQ ID NO: 77607
  derived and/or modified sequence opt1 from neuraminidase__InfluenzaA__AHL90641

SEQ ID NO: 85646 - RNA, 1410 nt, Artificial Sequence; identical to SEQ ID NO: 77520
  derived and/or modified sequence opt1 from neuraminidase__InfluenzaA__AHL90653

SEQ ID NO: 85647 - RNA, 1410 nt, Artificial Sequence; identical to SEQ ID NO: 77607
  derived and/or modified sequence opt1 from neuraminidase__InfluenzaA__AHL90665

SEQ ID NO: 85648 - RNA, 1410 nt, Artificial Sequence
  derived and/or modified sequence opt1 from neuraminidase__InfluenzaA__AHL90677
augaaccccaaccagaagaucaucaccaucggcagcgugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggaagcugguggacuccaucgugagcugguccaaggagauccugcggacgcaggagagcgagugcgucugcaucaacgggaccugcaccguggugaugaccgacggguccgccagcggcaaggccgacacgaagauccucuucaucgaggagggcaagaucguccacaccagcacccuguccgggagcgcgcagcacguggaggagugcuccugcuacccccgcuaccccggcgugcggugcgucugccgcgacaacuggaaggggagcaaccggccgaucguggacaucaacaucaaggaccacuccaucgugagcuccuacgucugcagcggccuggugggcgacacgccccgcaagaacgacuccagcuccagcucccacugccucgaccccaacaacgaggagggcggccacggggugaagggcugggccuucgacgacgggaacgacgucuggaugggccggaccaucagcgagaagucccgccugggcuacgagaccuucaaggugaucgagggguggagcaaccccaaguccaagcugcagaucaaccggcaggucaucguggaccgcggcaaccggagcggguacuccggcaucuucagcguggagggcaagagcugcaucaaccgcugcuucuacgucgagcucauccgggggcgcaaggaggagaccgaggugcuguggaccuccaacagcaucguggucuucugcggcacguccgggaccuacggcaccgggagcuggccggacggcgccgacaucaaccugaugcccaucuga

SEQ ID NO: 85649 - RNA, 1410 nt, Artificial Sequence; identical to SEQ ID NO: 77607
  derived and/or modified sequence opt1 from neuraminidase__InfluenzaA__AHL90689

SEQ ID NO: 85650 - RNA, 1410 nt, Artificial Sequence
  derived and/or modified sequence opt1 from neuraminidase__InfluenzaA__AHL90701
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcgggggcaucugggucacccgggagcccuacgugagcugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggacauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguaccccgggguccgcugcgugugccgggacaacuggaagggcagcaaccgcccgaucguggacaucaacaucaaggaccacuccaucgucagcuccuacgugugcagcggccuggugggggacacgccccggaagaacgacuccagcuccagcucccacugccucgaccccaacaacgaggagggcgggcacggcgucaaggggugggccuucgacgacggcaacgacguguggaugggccgcaccaucagcgagaagucccggcugggguacgagaccuucaaggucaucgagggcuggagcaaccccaaguccaagcugcagaucaaccgccaggugaucguggaccgggggaaccgcagcggcuacuccgggaucuucagcgucgagggcaagagcugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 85651 - RNA, 1410 nt, Artificial Sequence; identical to SEQ ID NO: 80312
  derived and/or modified sequence opt1 from neuraminidase__InfluenzaA__AHL90713

SEQ ID NO: 85652 - RNA, 1413 nt, Artificial Sequence; identical to SEQ ID NO: 80945
  derived and/or modified sequence opt1 from neuraminidase__InfluenzaA__AHL90725

SEQ ID NO: 85653 - RNA, 1413 nt, Artificial Sequence; identical to SEQ ID NO: 79938
  derived and/or modified sequence opt1 from neuraminidase__InfluenzaA__AHL90749

SEQ ID NO: 85654 - RNA, 1413 nt, Artificial Sequence; identical to SEQ ID NO: 78469
  derived and/or modified sequence opt1 from neuraminidase__InfluenzaA__AHL90761

SEQ ID NO: 85655 - RNA, 1413 nt, Artificial Sequence
  derived and/or modified sequence opt1 from neuraminidase__InfluenzaA__AHL90773
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggaccgcgagggcuccugcaacccggucaccguggacggggcgaacggcgugaagggguucagcuacaaguacggcaacggcgucuggaucgggcggacgaaguccaaccgccugcggaagggcuucgagaugaucugggaccccaacggguggaccaacaccgacagcgacuucuccgugaagcaggacguggucgccaucaccgacuggagcggcuacagcggguccuucgugcagcaccccgagcucacgggccuggacugcauccgccccugcuucuggguggagcugguccggggccucccgcgcgagaacaccaccaucuggaccagcggguccagcaucuccuucugcggcgugaacagcgacacggccaacugguccuggcccgacggggccgagcugcccuucaccaucgacaaguga

SEQ ID NO: 85656 - RNA, 1413 nt, Artificial Sequence
  derived and/or modified sequence opt1 from neuraminidase__InfluenzaA__AHL90785
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaucaccaucuggaccagcggcuccagcaucuccuucugcggggucaacagcgacaccgccaacugguccuggcccgacggcgccgagcugcccuucacgaucgacaaguga

SEQ ID NO: 85657 - RNA, 1413 nt, Artificial Sequence
  derived and/or modified sequence opt1 from neuraminidase__InfluenzaA__AHL90797
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaacaagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucgccugcucccaccucgagugccggacguucuuccugacccagggggcccugcucaacgacaagcacagcaacggcaccgucaaggaccgcucccccuaccgggcgcugaugagcugcccccugggggaggcccccuccccguacaacagcaaguucgagagcguggccugguccgccagcgcgugccacgacggcaugggcuggcucaccaucgggaucuccggccccgacaacggggccguggccguccugaaguacaacggcaucaucacgggcaccaucaagagcuggaagaagcagauccugcgcacccaggaguccgagugcgugugcaugaacgggagcugcuucaccaucaugacggacggccccuccgacaaggccgccagcuacaagaucuucaagaucgagaaggggaaggugaccaaguccaucgagcucaacgcgcccaacuuccacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggagcugcuccccggugaccguggacggcgccaacggggucaagggcuucagcuacaaguacgacaacggcguguggaucgggcgcacgaaguccaaccggcugcgcaagggcuucgaggugaucugggaccccaacggguggaccaacaccgacagcgacuucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccagcggguccagcaucuccuucugcggcgugaacagcgacacggccaacugguccuggcccgacggggccgagcugcccuucaccaucgacaaguga

SEQ ID NO: 85658 - RNA, 1413 nt, Artificial Sequence; identical to SEQ ID NO: 78469
  derived and/or modified sequence opt1 from neuraminidase__InfluenzaA__AHL90809

SEQ ID NO: 85659 - RNA, 1413 nt, Artificial Sequence; identical to SEQ ID NO: 80945
  derived and/or modified sequence opt1 from neuraminidase__InfluenzaA__AHL90821

SEQ ID NO: 85660 - RNA, 1413 nt, Artificial Sequence
  derived and/or modified sequence opt1 from neuraminidase__InfluenzaA__AHL90833
augaaccccaaccagcgcaucaucaccaucggcagcaucuccaucgccaucgggaucaucagccugaugcuccagaucggcaacaucaucuccaucugggccagccacuccauccagaccgggagccagaacaacacgggcaucugcaaccagcggaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccgcaucgggagcaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccagcccguacaacagcaaguucgaguccgucgccuggagcgccuccgcgugccacgacggcaugggcuggcucaccaucgggaucagcggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccagcaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaugggcuacaucugcagcggcguguucggggacaacccccgccccgaggacggcgagggguccugcaacccggucaccguggacggcgccaacggggugaagggcuucagcuacaaguacggcaacggggucuggaucggccggacgaaguccaaccgccugcggaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccgccccugcuucuggguggagcugguccgggggcucccgcgcgagaacaccaccaucuggaccagcggcuccagcaucuccuucugcggggugaacagcgacacggccaacugguccuggcccgacggcgccgagcugcccuucaccaucgacaaguga

SEQ ID NO: 85661 - RNA, 1413 nt, Artificial Sequence; identical to SEQ ID NO: 78469
  derived and/or modified sequence opt1 from neuraminidase__InfluenzaA__AHL90845

SEQ ID NO: 85662 - RNA, 1413 nt, Artificial Sequence; identical to SEQ ID NO: 79938
  derived and/or modified sequence opt1 from neuraminidase__InfluenzaA__AHL90857

SEQ ID NO: 85663 - RNA, 1413 nt, Artificial Sequence; identical to SEQ ID NO: 78469
  derived and/or modified sequence opt1 from neuraminidase__InfluenzaA__AHL90869

SEQ ID NO: 85664 - RNA, 1413 nt, Artificial Sequence
  derived and/or modified sequence opt1 from neuraminidase__InfluenzaA__AHL90881
augaaccccaaccagaagaucaucaccaucggcagcaucuccaucgccaucgggaucaucagcaccaugcugcagaucggcuccaucaucagcaucugggccucccacagcauccagacggggucccagaacaacaccggcaucugcaaccagcgcaucaucaccuacgagaacagcaccugggugaaccacacguacgucaacaucaacaacaccaacgugguggcgggggaggacaagaccuccgucacccucgccggcaacagcucccugugcagcaucuccggcugggccaucuacacgaaggacaacagcauccggaucggguccaagggcgacguguucgugauccgcgagccguucaucagcugcucccaccuggagugccggaccuucuuccucacccagggggcccugcugaacgacaagcacagcaacggcaccgucaaggaccgcucccccuaccgggcccucaugagcugcccccugggggaggcgcccagcccguacaacuccaaguucgagagcguggccugguccgccagcgccugccacgacggcaugggcuggcugacgaucgggaucuccggccccgacaacggggcgguggccguccucaaguacaacggcaucaucaccggcaccaucaagagcuggaagaagcagauccugcgcacccaggaguccgagugcgugugcaugaacgggagcugcuucacgaucaugaccgacggccccuccaacaaggccgccagcuacaagaucuucaagaucgagaaggggaaggugaccaaguccaucgagcugaacgcccccaacuucuacuacgaggagugcagcugcuacccggacaccggcaucgucaugugcgugugccgggacaacuggcacggguccaaccgccccugggugagcuucaaccagaaccucgacuaccagaucggcuacaucugcuccggcgucuucggggacaacccccggcccgaggacggcgaggggagcugcaacccggugacgguggacggcgcgaacggggucaagggcuucuccuacaaguacggcaacgggguguggaucggccgcaccaagagcaaccggcugaucaagggguucgagaugaucugggaccccaacggcuggaccaacaccgacuccgacuucagcgugaagcaggacgucguggccaucacggacuggagcggguacuccggcagcuucgugcagcaccccgagcugaccggccucgacugcauccgccccugcuucugggucgagcuggugcgggggcugccgcgcgagaacaccaccaucuggacguccggcagcuccaucagcuucugcggggucaacuccgacaccgccaacuggagcuggcccgacggcgccgagcuccccuucaccaucgacaaguga

SEQ ID NO: 85665 - RNA, 1413 nt, Artificial Sequence; identical to SEQ ID NO: 80945
  derived and/or modified sequence opt1 from neuraminidase__InfluenzaA__AHL90893

SEQ ID NO: 85666 - RNA, 1413 nt, Artificial Sequence; identical to SEQ ID NO: 79938
  derived and/or modified sequence opt1 from neuraminidase__InfluenzaA__AHL90905

SEQ ID NO: 85667 - RNA, 1413 nt, Artificial Sequence
  derived and/or modified sequence opt1 from neuraminidase__InfluenzaA__AHL90917
augaaccccaaccagaagaucaucaccaucggcagcaucuccaucgccaucgggaucaucagccugacccuccagaucggcaacaucaucuccaucugggccagccacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccagccugugcuccaucagcggcugggccaucuacacgaaggacaacuccauccggaucgggagcaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucacgaucgggaucagcggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacagcgacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgagcggcuccagcaucuccuucugcggggucaacagcgacaccgccaacugguccuggcccgacggcgccgagcugcccuucaccaucgacaaguga

SEQ ID NO: 85668 - RNA, 1413 nt, Artificial Sequence
  derived and/or modified sequence opt1 from neuraminidase__InfluenzaA__AHL90929
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcaugacccuggccggcaacuccagccugugcuccaucagcggcugggccaucuacaccaaggacaacuccauccggaucgggagcaagggcgacgucuucgugauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcgcccagcccguacaacagcaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagagcgagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacagcgacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccagcggcuccagcaucuccuucugcggggugaacagcgacacggccaacugguccuggcccgacggcgccgagcugcccuucaccaucgacaaguga

SEQ ID NO: 85669 - RNA, 1413 nt, Artificial Sequence; identical to SEQ ID NO: 79938
  derived and/or modified sequence opt1 from neuraminidase__InfluenzaA__AHL90941

SEQ ID NO: 85670 - RNA, 1413 nt, Artificial Sequence; identical to SEQ ID NO: 79938
  derived and/or modified sequence opt1 from neuraminidase__InfluenzaA__AHL90953

SEQ ID NO: 85671 - RNA, 1413 nt, Artificial Sequence; identical to SEQ ID NO: 79938
  derived and/or modified sequence opt1 from neuraminidase__InfluenzaA__AHL90965

SEQ ID NO: 85672 - RNA, 1413 nt, Artificial Sequence
  derived and/or modified sequence opt1 from neuraminidase__InfluenzaA__AHL90977
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucagcggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccagcccguacaacagcaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucguggccaucgccgacuggagcggguacagcggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 85673 - RNA, 1413 nt, Artificial Sequence; identical to SEQ ID NO: 81212
  derived and/or modified sequence opt1 from neuraminidase__InfluenzaA__AHL90989

SEQ ID NO: 85674 - RNA, 1413 nt, Artificial Sequence; identical to SEQ ID NO: 85668
  derived and/or modified sequence opt1 from neuraminidase__InfluenzaA__AHL91001

SEQ ID NO: 85675 - RNA, 1413 nt, Artificial Sequence
  derived and/or modified sequence opt1 from neuraminidase__InfluenzaA__AHL91013
augaaccccaaccagaagaucaucaccaucggcagcaucuccaucgccaucgggaucaucagccugaugcuccagaucggcaacaucaucuccaucugggccagccacuccauccagaccgggagccagaacaacacgggcaucugcucccagcgcaucaucaccuacgagaacagcaccugggugaaccacaccuacgucaacaucaacaacacgaacgugguggcgggggaggacaagaccuccaugacccuggccggcaacagcucccugugcagcaucuccggcugggccaucuacaccaaggacaacagcauccggaucggguccaagggcgacgucuucgugauccgcgagccguucaucagcugcucccaccucgagugccggacguucuuccugacccagggggcccugcucaacgacaagcacagcaacggcaccgugaaggaccgcucccccuaccgggcccugaugagcugcccccugggggaggcgcccagcccguacaacuccaaguucgagagcgucgccugguccgccagcgccugccacgacggcaugggcuggcucaccaucgggaucuccggccccgacaacggggcgguggccgugcugaaguacaacggcaucaucacgggcaccauccgcagcuggaagaagcagauccugcggacccaggaguccgagugcgucugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgugaugugcgucugccgcgacaacuggcacggguccaaccggcccugggugagcuucaaccagaaccuggacuaccagaucggcuacaucugcuccggcguguucggggacaacccccgccccgaggacggcgaggggagcugcaacccggucaccguggacggcgcgaacggggugaagggcuucuccuacaaguacggcaacggggucuggaucggccggaccaagagcaaccgccugcggaagggguucgagaugaucugggaccccaacggcuggacgaacaccgacuccgacuucagcgugaagcaggacguggucgccaucaccgacuggagcggguacuccggcagcuucgugcagcaccccgagcucacgggccuggacugcauccgccccugcuucuggguggagcugguccgggggcucccgcgcgagaacaccaccaucuggaccuccggcagcuccaucagcuucugcggggugaacuccgacacggccaacuggagcuggcccgacggcgccgagcugcccuucaccaucgacaaguga

SEQ ID NO: 85676 - RNA, 1413 nt, Artificial Sequence; identical to SEQ ID NO: 85668
  derived and/or modified sequence opt1 from neuraminidase__InfluenzaA__AHL91025

SEQ ID NO: 85677 - RNA, 1410 nt, Artificial Sequence; identical to SEQ ID NO: 78913
  derived and/or modified sequence opt1 from neuraminidase__InfluenzaA__AHL91037

SEQ ID NO: 85678 - RNA, 1410 nt, Artificial Sequence; identical to SEQ ID NO: 80526
  derived and/or modified sequence opt1 from neuraminidase__InfluenzaA__AHL91049

SEQ ID NO: 85679 - RNA, 1410 nt, Artificial Sequence
  derived and/or modified sequence opt1 from neuraminidase__InfluenzaA__AHL91061
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucaaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 85680 - RNA, 1410 nt, Artificial Sequence
  derived and/or modified sequence opt1 from neuraminidase__InfluenzaA__AHL91073
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaccuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacgcaggagagcgagugcgugugcaucaacgggaccugcaccguggucaugaccgacggcuccgccagcggcaaggccgacacgaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccgggagccacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggagcaaccacaagagcaagcugcagaucaaccgccaggugaucguggaccgggggaaccgcuccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugccgaucuga

SEQ ID NO: 85681 - RNA, 1410 nt, Artificial Sequence
  derived and/or modified sequence opt1 from neuraminidase__InfluenzaA__AHL91085
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagcuggccgaguaccggaacuggagcaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccagcuccugccacgacgggaaggccuggcuccacgugugcaucacgggcgacgacaagaacgcgaccgccagcuucaucuacaacgggcggcugguggacuccguggucagcugguccaaggagauccugcgcacccaggagagcgagugcgugugcaucaacggcaucugcaccguggucaugacggacggguccgccagcggcaaggccgacaccaagauccucuucaucgaggagggcaagaucgugcacaccagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccccaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggacguccaacagcaucgucguguucugcggcaccuccgggaccuacggcaccgggagcuggccggacggcgccgacaucaaccugaugcccaucuga

SEQ ID NO: 85682 - RNA, 1410 nt, Artificial Sequence; identical to SEQ ID NO: 77607
  derived and/or modified sequence opt1 from neuraminidase__InfluenzaA__AHL91097

SEQ ID NO: 85683 - RNA, 1410 nt, Artificial Sequence
  derived and/or modified sequence opt1 from neuraminidase__InfluenzaA__AHL91109
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaacaucaugccgaucuga

SEQ ID NO: 85684 - RNA, 1410 nt, Artificial Sequence; identical to SEQ ID NO: 78913
  derived and/or modified sequence opt1 from neuraminidase__InfluenzaA__AHL91121

SEQ ID NO: 85685 - RNA, 1410 nt, Artificial Sequence
  derived and/or modified sequence opt1 from neuraminidase__InfluenzaA__AHL91133
augaaccccaaccagaagaucaucaccaucggcagcgugucccugaccaucagcacgaucugcuucuucaugcagaucgccauccucaucaccaccgucacccugcacuucaagcaguucgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccagcuccugccacgacgggaaggccuggcuccacgugugcaucaccggcgacgacaagaacgcgaccgccagcuucaucuacaacgggcggcugguggacuccguggucagcugguccaaggagauccugcgcacccaggagagcgagugcgugugcaucaacggcacgugcaccguggucaugaccgacggguccgccagcggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggagcaaccgcccgaucguggacaucaacaucaaggaccacuccaucgucagcuccuacgugugcagcggccuggugggcgacacgccccggaagaacgacuccagcuccagcucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggagcaaccacaaguccaagcugcagaucaaccgccaggugaucguggaccggggcaaccgcagcggguacuccggcaucuucagcgucgagggcaagagcugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 85686 - RNA, 1410 nt, Artificial Sequence; identical to SEQ ID NO: 80312
  derived and/or modified sequence opt1 from neuraminidase__InfluenzaA__AHL91145

SEQ ID NO: 85687 - RNA, 1410 nt, Artificial Sequence; identical to SEQ ID NO: 80312
  derived and/or modified sequence opt1 from neuraminidase__InfluenzaA__AHL91157

SEQ ID NO: 85688 - RNA, 1410 nt, Artificial Sequence; identical to SEQ ID NO: 75720
  derived and/or modified sequence opt1 from neuraminidase__InfluenzaA__AHL91169

SEQ ID NO: 85689 - RNA, 1410 nt, Artificial Sequence; identical to SEQ ID NO: 83154
  derived and/or modified sequence opt1 from neuraminidase__InfluenzaA__AHL94987

SEQ ID NO: 85690 - RNA, 1410 nt, Artificial Sequence; identical to SEQ ID NO: 83154
  derived and/or modified sequence opt1 from neuraminidase__InfluenzaA__AHL94999

SEQ ID NO: 85691 - RNA, 1410 nt, Artificial Sequence
  derived and/or modified sequence opt1 from neuraminidase__InfluenzaA__AHL95011
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacaccccgcgcaagaacgacagcuccagcuccagccacugccuggaccccaacaacgaggagggcgggcacggggucaagggcugggccuucgacgacgggaacgacguguggaugggccggaccaucaacgagacgucccgccucggcuacgagaccuucaaggucaucgaggggugguucaaccccaagagcaagcugcagaucaaccgccaggugaucguggaccggggcgaccgguccggguacagcggcaucuucuccgucgagggcaagagcugcaucaaccgcugcuucuacguggagcugauccgggggcgcaaggaggagaccgaggugcucuggaccuccaacagcaucgucguguucugcggcacgagcgggaccuacggcaccggguccuggcccgacggcgccgaccugaaccugaugcccaucuga

SEQ ID NO: 85692 - RNA, 1410 nt, Artificial Sequence; identical to SEQ ID NO: 84911
  derived and/or modified sequence opt1 from neuraminidase__InfluenzaA__AHL95023

SEQ ID NO: 85693 - RNA, 1410 nt, Artificial Sequence; identical to SEQ ID NO: 83154
  derived and/or modified sequence opt1 from neuraminidase__InfluenzaA__AHL95035

SEQ ID NO: 85694 - RNA, 1410 nt, Artificial Sequence; identical to SEQ ID NO: 83154
  derived and/or modified sequence opt1 from neuraminidase__InfluenzaA__AHL95047

SEQ ID NO: 85695 - RNA, 1410 nt, Artificial Sequence; identical to SEQ ID NO: 84902
  derived and/or modified sequence opt1 from neuraminidase__InfluenzaA__AHL95059

SEQ ID NO: 85696 - RNA, 1410 nt, Artificial Sequence; identical to SEQ ID NO: 83154
  derived and/or modified sequence opt1 from neuraminidase__InfluenzaA__AHL95071

SEQ ID NO: 85697 - RNA, 1410 nt, Artificial Sequence; identical to SEQ ID NO: 83154
  derived and/or modified sequence opt1 from neuraminidase__InfluenzaA__AHL95083

SEQ ID NO: 85698 - RNA, 1410 nt, Artificial Sequence; identical to SEQ ID NO: 83154
  derived and/or modified sequence opt1 from neuraminidase__InfluenzaA__AHL95095

SEQ ID NO: 85699 - RNA, 1410 nt, Artificial Sequence; identical to SEQ ID NO: 83154
  derived and/or modified sequence opt1 from neuraminidase__InfluenzaA__AHL95107

SEQ ID NO: 85700 - RNA, 1410 nt, Artificial Sequence
  derived and/or modified sequence opt1 from neuraminidase__InfluenzaA__AHL95119
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacaccccgcgcaagaacgacagccuguccagcucccacugccucgaccccaacaacgaggagggcgggcacggggucaagggcugggccuucgacgacgggaacgacguguggaugggccggaccaucaacgagacgagccgccugggcuacgagaccuucaaggucaucgaggggugguccaaccccaagagcaagcugcagaucaaccgccaggugaucguggaccggggcgaccgguccggguacagcggcaucuucuccgucgagggcaagagcugcaucaaccgcugcuucuacguggagcucauccgggggcgcaaggaggagaccgaggugcuguggaccuccaacagcaucgucguguucugcggcacgagcgggaccuacggcaccggguccuggcccgacggcgccgaccugaaccucaugcccaucuga

SEQ ID NO: 85701 - RNA, 1410 nt, Artificial Sequence; identical to SEQ ID NO: 84383
  derived and/or modified sequence opt1 from neuraminidase__InfluenzaA__AHL95131

SEQ ID NO: 85702 - RNA, 1410 nt, Artificial Sequence; identical to SEQ ID NO: 84891
  derived and/or modified sequence opt1 from neuraminidase__InfluenzaA__AHL95143

SEQ ID NO: 85703 - RNA, 1410 nt, Artificial Sequence
  derived and/or modified sequence opt1 from neuraminidase__InfluenzaA__AHL95155
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacuccagcuccagcucccacugccuggaccccaacaacgaggagggcagccacggggucaagggcugggccuucgacgacgggaacgacguguggaugggccgcaccaucaacgagaccucccggcucggcuacgagaccuucaaggucaucgagggguggagcaacccgaaguccaagcugcagaucaaccgccaggugaucguggaccggggcgaccgcagcggguacuccggcaucuucagcgucgagggcaagagcugcaucaaccggugcuucuacguggagcugauccgcgggcggaaggaggagaccgaggugcucuggaccuccaacagcaucgucguguucugcggcacguccgggaccuacggcaccgggagcuggcccgacggcgccgaccugaaccugaugcccaucuga

SEQ ID NO: 85704 - RNA, 1410 nt, Artificial Sequence
  derived and/or modified sequence opt1 from neuraminidase__InfluenzaA__AHL95167
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguaccugugcuccggccuggugggcgacacgccccgcaagaacgacagcuccagcuccagccacugccucgaccccaacaacgaggagggcgggcacggggugaagggcugggccuucgacgacgggaacgacgucuggaugggccggaccaucaacgagaccucccgccugggcuacgagaccuucaaggugaucgagggguggagcaacccgaaguccaagcugcagaucaaccggcaggucaucguggaccgcggcgaccggagcggguacuccggcaucuucagcguggaggggaaguccugcaucaaccgcugcuucuacgucgagcucauccggggccgcaaggaggagaccgaggugcuguggaccagcaacagcaucguggucuucugcggcacguccgggaccuacggcaccgggagcuggcccgacggcgccgaccugaaccucaugcccaucuga

SEQ ID NO: 85705 - RNA, 1410 nt, Artificial Sequence; identical to SEQ ID NO: 83154
  derived and/or modified sequence opt1 from neuraminidase__InfluenzaA__AHL95179

SEQ ID NO: 85706 - RNA, 1410 nt, Artificial Sequence; identical to SEQ ID NO: 83154
  derived and/or modified sequence opt1 from neuraminidase__InfluenzaA__AHL95191

SEQ ID NO: 85707 - RNA, 1410 nt, Artificial Sequence; identical to SEQ ID NO: 83154
  derived and/or modified sequence opt1 from neuraminidase__InfluenzaA__AHL95203

SEQ ID NO: 85708 - RNA, 1410 nt, Artificial Sequence; identical to SEQ ID NO: 83154
  derived and/or modified sequence opt1 from neuraminidase__InfluenzaA__AHL95215

SEQ ID NO: 85709 - RNA, 1410 nt, Artificial Sequence
  derived and/or modified sequence opt1 from neuraminidase__InfluenzaA__AHL95227
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcgggagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85710 - RNA, 1410 nt, Artificial Sequence; identical to SEQ ID NO: 84891
  derived and/or modified sequence opt1 from neuraminidase__InfluenzaA__AHL95239

SEQ ID NO: 85711 - RNA, 1410 nt, Artificial Sequence
  derived and/or modified sequence opt1 from neuraminidase__InfluenzaA__AHL95251
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucaaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85712 - RNA, 1410 nt, Artificial Sequence; identical to SEQ ID NO: 83154
  derived and/or modified sequence opt1 from neuraminidase__InfluenzaA__AHL95263

SEQ ID NO: 85713 - RNA, 1410 nt, Artificial Sequence
  derived and/or modified sequence opt1 from neuraminidase__InfluenzaA__AHL95275
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagccggccgaguaccggaacuggagcaagccccagugcgggaucacgggcuucgcgcccuucuccaaggacaacagcauccgccuguccgccgggggcgacaucugggucacccgggagcccuacgugagcugcgacccggacaagugcuaccaguucgcccuggggcagggcaccacccucaacaacgugcacuccaacaacacgguccgcgaccggacccccuaccgcacccugcugaugaacgagcucggcgugcccuuccaccuggggaccaagcaggucugcaucgccuggagcuccagcuccugccacgacggcaaggccuggcugcacgugugcaucacgggggacgacaagaacgcgaccgccagcuucaucuacaacggccggcucguggacuccguggucagcugguccaaggagauccugcgcacccaggagagcgagugcgugugcaucaacgggaccugcacgguggucaugaccgacggcuccgccagcggcaaggccgacaccaagauccuguucaucgaggaggggaagaucgugcacaccagcacgcucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagaccagccggcucggguacgagacguucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggaccagcggcacguacgggaccggcuccuggcccgacggggccgaccugaaccugaugcccaucuga

SEQ ID NO: 85714 - RNA, 1410 nt, Artificial Sequence; identical to SEQ ID NO: 84397
  derived and/or modified sequence opt1 from neuraminidase__InfluenzaA__AHL95299

SEQ ID NO: 85715 - RNA, 1410 nt, Artificial Sequence
  derived and/or modified sequence opt1 from neuraminidase__InfluenzaA__AHL95310
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccuggaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccgccaggugaucguggaccggggcgaccggagcggguacuccggcaucuucagcgucgaggggaaguccugcaucaaccgcugcuucuacguggagcugauccggggccgcaaggaggagaccgaggugcucuggaccagcaacagcaucgucguguucugcggcacguccgggaccuacggcaccgggagcuggcccgacggcgccaaccugaaccugaugcccaucuga

SEQ ID NO: 85716 - RNA, 1410 nt, Artificial Sequence; identical to SEQ ID NO: 84902
  derived and/or modified sequence opt1 from neuraminidase__InfluenzaA__AHL95322

SEQ ID NO: 85717 - RNA, 1410 nt, Artificial Sequence; identical to SEQ ID NO: 84879
  derived and/or modified sequence opt1 from neuraminidase__InfluenzaA__AHL95334

SEQ ID NO: 85718 - RNA, 1410 nt, Artificial Sequence; identical to SEQ ID NO: 83154
  derived and/or modified sequence opt1 from neuraminidase__InfluenzaA__AHL95423

SEQ ID NO: 85719 - RNA, 1410 nt, Artificial Sequence; identical to SEQ ID NO: 84902
  derived and/or modified sequence opt1 from neuraminidase__InfluenzaA__AHL95435

SEQ ID NO: 85720 - RNA, 1410 nt, Artificial Sequence; identical to SEQ ID NO: 84879
  derived and/or modified sequence opt1 from neuraminidase__InfluenzaA__AHL95447

SEQ ID NO: 85721 - RNA, 1410 nt, Artificial Sequence
  derived and/or modified sequence opt1 from neuraminidase__InfluenzaA__AHL95461
augaaccccaaccagaagaucaucaccaucggcagcgugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggucacccgggagccguacguguccugcgggcccgacaagugcuaccaguucgcccugggccagggcaccacgcucaacaacaugcacagcaacaacaccgugcgcgaccggacccccuaccgcacccugcugaugaacgagcucgggguccccuuccaccugggcacgaagcaggucugcaucgccugguccagcuccagcugccacgacgggaaggccuggcugcacgugugcaucaccggcgacgacaagaacgcgaccgccuccuucaucuacaacgggcggcucguggacagcgugguguccuggagcaaggagauccugcgcacccaggaguccgagugcgucugcaucaacggcacgugcaccguggugaugaccgacggcagcgccuccgggaaggccgacaccaagauccuguucaucgaggagggcaagaucguccacacgagcacccucagcggguccgcgcagcacguggaggagugcagcugcuacccgcgguaccccggcgugcgcugcgucugccgggacaacuggaagggcuccaaccgccccaucguggacaucaacaucaaggaccacagcaucguguccagcuacgucugcuccgggcuggugggcgacacgccccggaagaacgacagcuccagcuccagccacugccuggacccgaacaacgaggagggcgggcacggggugaagggcugggccuucgacgacggcaacgacgucuggauggggcgcaccaucaacgagaccucccggcucggcuacgagaccuucaaggugaucgagggguggagcaaccccaaguccaagcugcagaucaaccgccaggucaucguggaccggggcgaccgcagcggguacuccggcaucuucagcguggagggcaaguccugcaucaaccggugcuucuacgucgagcugauccgcgggcggaaggaggagaccgaggugcucuggaccagcaacagcaucguggucuucugcggcacguccgggaccuacggcaccgggagcuggcccgacggcgccgaccugaaccugaugcccaucuga

SEQ ID NO: 85722 - RNA, 1410 nt, Artificial Sequence; identical to SEQ ID NO: 83930
  derived and/or modified sequence opt1 from neuraminidase__InfluenzaA__AHL95473

SEQ ID NO: 85723 - RNA, 1410 nt, Artificial Sequence; identical to SEQ ID NO: 83154
  derived and/or modified sequence opt1 from neuraminidase__InfluenzaA__AHL95485

SEQ ID NO: 85724 - RNA, 1410 nt, Artificial Sequence; identical to SEQ ID NO: 83154
  derived and/or modified sequence opt1 from neuraminidase__InfluenzaA__AHL95497

SEQ ID NO: 85725 - RNA, 1410 nt, Artificial Sequence
  derived and/or modified sequence opt1 from neuraminidase__InfluenzaA__AHL95509
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaagaaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85726 - RNA, 1410 nt, Artificial Sequence; identical to SEQ ID NO: 83154
  derived and/or modified sequence opt1 from neuraminidase__InfluenzaA__AHL95521

SEQ ID NO: 85727 - RNA, 1410 nt, Artificial Sequence; identical to SEQ ID NO: 83154
  derived and/or modified sequence opt1 from neuraminidase__InfluenzaA__AHL95533

SEQ ID NO: 85728 - RNA, 1410 nt, Artificial Sequence; identical to SEQ ID NO: 83154
  derived and/or modified sequence opt1 from neuraminidase__InfluenzaA__AHL95545

SEQ ID NO: 85729 - RNA, 1410 nt, Artificial Sequence
  derived and/or modified sequence opt1 from neuraminidase__InfluenzaA__AHL95557
augaaccccaaccagaagaucaucaccaucggcagcgugucccugaccaucagcacgaucugcuucuucauccagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacacgccccggaagaacgacuccagcuccagcucccacugccuggaccccaacaacgaggagggcgggcacggcgugaaggggugggccuucgacgacggcaacgacgucuggaugggccgcaccaucaacgagaccagccggcucggguacgagaccuucaaggugaucgagggcugguccaacccggagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85730 - RNA, 1410 nt, Artificial Sequence; identical to SEQ ID NO: 84879
  derived and/or modified sequence opt1 from neuraminidase__InfluenzaA__AHL95569

SEQ ID NO: 85731 - RNA, 1410 nt, Artificial Sequence; identical to SEQ ID NO: 83154
  derived and/or modified sequence opt1 from neuraminidase__InfluenzaA__AHL95581

SEQ ID NO: 85732 - RNA, 1410 nt, Artificial Sequence
  derived and/or modified sequence opt1 from neuraminidase__InfluenzaA__AHL95605
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacaucuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85733 - RNA, 1410 nt, Artificial Sequence; identical to SEQ ID NO: 83154
  derived and/or modified sequence opt1 from neuraminidase__InfluenzaA__AHL95617

SEQ ID NO: 85734 - RNA, 1410 nt, Artificial Sequence; identical to SEQ ID NO: 83154
  derived and/or modified sequence opt1 from neuraminidase__InfluenzaA__AHL95629

SEQ ID NO: 85735 - RNA, 1410 nt, Artificial Sequence; identical to SEQ ID NO: 83154
  derived and/or modified sequence opt1 from neuraminidase__InfluenzaA__AHL95641

SEQ ID NO: 85736 - RNA, 1410 nt, Artificial Sequence; identical to SEQ ID NO: 83154
  derived and/or modified sequence opt1 from neuraminidase__InfluenzaA__AHL95653

SEQ ID NO: 85737 - RNA, 1410 nt, Artificial Sequence; identical to SEQ ID NO: 85732
  derived and/or modified sequence opt1 from neuraminidase__InfluenzaA__AHL95665

SEQ ID NO: 85738 - RNA, 1410 nt, Artificial Sequence; identical to SEQ ID NO: 83154
  derived and/or modified sequence opt1 from neuraminidase__InfluenzaA__AHL95677

SEQ ID NO: 85739 - RNA, 1410 nt, Artificial Sequence
  derived and/or modified sequence opt1 from neuraminidase__InfluenzaA__AHL95689
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccaaccugaaccugaugcccaucuga

SEQ ID NO: 85740 - RNA, 1410 nt, Artificial Sequence; identical to SEQ ID NO: 83154
  derived and/or modified sequence opt1 from neuraminidase__InfluenzaA__AHL95701

SEQ ID NO: 85741 - RNA, 1410 nt, Artificial Sequence; identical to SEQ ID NO: 83154
  derived and/or modified sequence opt1 from neuraminidase__InfluenzaA__AHL95713

SEQ ID NO: 85742 - RNA, 1410 nt, Artificial Sequence
  derived and/or modified sequence opt1 from neuraminidase__InfluenzaA__AHL95725
augaaccccaaccagaagaucaucaccaucggcagcgugucccugaccaucagcacgaucugcuucuucaugcagaucgccauccucaucaccaccgucacccugcacuucaagcaguacgaguucgacccgccgcccaacaaccaggugaugcugugcgagcccacgaucaucgagcgcaacaucaccgagaucguguaccucaccaacaccacgaucgagaaggagaucugccccaagcccgccgaguaccggaacugguccaagccccagugcgggaucaccggcuucgcgcccuucagcaaggacaacuccauccgccugagcgccgggggcgacaucugggucacccgggagccguacguguccugcgaccccgacaagugcuaccaguucgcccuggggcagggcaccacgcucaacaacgugcacagcaacaacaccguccgcgaccggacccccuaccgcacccugcugaugaacgagcucggcgugcccuuccaccuggggacgaagcaggucugcaucgccugguccagcuccagcugccacgacggcaaggccuggcugcacgugugcaucaccggggacgacaagaacgcgaccgccuccuucaucuacaacggccggcucguggacagcguggucuccuggagcaaggagauccugcgcacccaggaguccgagugcgugugcaucaacgggacgugcaccguggucaugaccgacggcagcgccuccggcaaggccgacaccaagauccuguucaucgaggaggggaagaucgugcacacgagcacccucagcggcuccgcgcagcacguggaggagugcagcugcuacccgcgguaccccgggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggacccgaacaacgaggagggcgggcacggcgucaaggggugggccuucgacgacggcaacgacguguggaugggccgcaccaucaacgagaccucccggcucggguacgagaccuucaaggucaucgagggcuggagcaaccccaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaucgaggugcucuggaccagcaacagcaucgucguguucugcgggaccuccggcacguacgggaccggcagcuggcccgacggggccgaccugaaccugaugcccaucuga

SEQ ID NO: 85743 - RNA, 1410 nt, Artificial Sequence; identical to SEQ ID NO: 84891
  derived and/or modified sequence opt1 from neuraminidase__InfluenzaA__AHL95737

SEQ ID NO: 85744 - RNA, 1410 nt, Artificial Sequence
  derived and/or modified sequence opt1 from neuraminidase__InfluenzaA__AHL95749
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccgcccgcgaccggacccccuaccgcacccugcugaugaacgagcucggcguccccuuccaccuggggacgaagcaggucugcaucgccuggagcuccagcuccugccacgacggcaaggcguggcugcacgugugcaucaccggggacgacaagaacgccaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggcggacaccaagauccuguucaucgaggaggggaagaucguccacacgagcacccucuccggcagcgcccagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85745 - RNA, 1410 nt, Artificial Sequence; identical to SEQ ID NO: 83154
  derived and/or modified sequence opt1 from neuraminidase__InfluenzaA__AHL95761

SEQ ID NO: 85746 - RNA, 1410 nt, Artificial Sequence; identical to SEQ ID NO: 83154
  derived and/or modified sequence opt1 from neuraminidase__InfluenzaA__AHL95773

SEQ ID NO: 85747 - RNA, 1410 nt, Artificial Sequence
  derived and/or modified sequence opt1 from neuraminidase__InfluenzaA__AHL95785
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcguccgccuguccgccggcggggacaucugggugacccgggagcccuacgugagcugcgacccggacaagugcuaccaguucgcccugggccaggggaccacgcucaacaacguccacuccaacaacaccgugcgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccgucgugagcugguccaaggagauccugcgcacccaggagagcgagugcgugugcaucaacggcacgugcaccgucgugaugaccgacggguccgccagcggcaaggccgacaccaagauccuguucaucgaggagggcaagaucgugcacacgagcacccucuccgggagcgcgcagcacgucgaggagugcuccugcuacccccgguacccgggcgugcgcugcgugugccgggacaacuggaaggggagcaaccgccccaucgucgacaucaacaucaaggaccacuccaucgugagcuccuacgugugcagcggccuggucggcgacaccccgcggaagaacgacuccagcuccagcucccacugccuggaccccaacaacgaggagggcgggcacggggugaagggcugggccuucgacgacgggaacgacgucuggaugggccgcaccaucaacgagacgagccggcucggcuacgagaccuucaaggugaucgaggggugguccaaccccaagagcaagcugcagaucaaccgccaggugaucgucgaccggggcgaccgcuccggguacagcggcaucuucuccguggagggcaagagcugcaucaaccggugcuucuacguggagcugauccgcgggcggaaggaggagaccgagguccucuggaccagcaacuccaucgugguguucugcggcacgagcgggaccuacggcaccggguccuggcccgacggcgccgaccugaaccugaugcccaucuga

SEQ ID NO: 85748 - RNA, 1410 nt, Artificial Sequence; identical to SEQ ID NO: 84879
  derived and/or modified sequence opt1 from neuraminidase__InfluenzaA__AHL95797

SEQ ID NO: 85749 - RNA, 1410 nt, Artificial Sequence; identical to SEQ ID NO: 83154
  derived and/or modified sequence opt1 from neuraminidase__InfluenzaA__AHL95833

SEQ ID NO: 85750 - RNA, 1410 nt, Artificial Sequence; identical to SEQ ID NO: 84879
  derived and/or modified sequence opt1 from neuraminidase__InfluenzaA__AHL95845

SEQ ID NO: 85751 - RNA, 1410 nt, Artificial Sequence
  derived and/or modified sequence opt1 from neuraminidase__InfluenzaA__AHL95857
augaaccccaaccagaagaucaucagcaucggcuccgugagccugaccaucuccaccaucugcuucuucaugcagaucgccauccucaucacgaccgucacccugcacuucaagcaguacgaguucaacagcccgcccaacaaccaggugaugcugugcgagcccaccaucaucgagcgcaacaucacggagaucguguaccucaccaacaccaccaucgagaaggagaucugccccaagccggccgaguaccggaacugguccaagccccagugcgggaucacgggcuucgcgcccuucagcaaggacaacuccauccgccugagcgccgggggcgacaucugggucacccgggagcccuacguguccugcgacccggacaagugcuaccaguucgcccuggggcagggcaccacccucaacaacgugcacagcaacaacacgguccgcgaccggacccccuaccgcacccugcugaugaacgagcucggcgugcccuuccaccuggggaccaagcaggucugcaucgccugguccagcuccagcugccacgacggcaaggccuggcugcacgugugcaucacgggggacgacaagaacgcgaccgccuccuucaucuacaacggccggcucguggacagcguggucuccuggagcaaggagauccugcgcacccaggaguccgagugcgugugcaucaacgggaccugcacgguggucaugaccgacggcagcgccagcggcaaggccgacaccaagauccuguucaucgaggaggggaagaucgugcacaccuccacgcucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaagagcugcaucaaccggugcuucuacguggagcugauccgcggccggaaggaggagaccgaggugcucuggaccuccaacagcaucgucguguucugcgggaccuccggcacguacgggaccggcagcuggcccgacggggccgaccugaaccugaugcccaucuga

SEQ ID NO: 85752 - RNA, 1410 nt, Artificial Sequence; identical to SEQ ID NO: 83154
  derived and/or modified sequence opt1 from neuraminidase__InfluenzaA__AHL95869

SEQ ID NO: 85753 - RNA, 1410 nt, Artificial Sequence
  derived and/or modified sequence opt1 from neuraminidase__InfluenzaA__AHL95881
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaaccuggccgcgggccaguccguggugagcgucaagcuggccgggaacuccagccucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 85754 - RNA, 1410 nt, Artificial Sequence
  derived and/or modified sequence opt1 from neuraminidase__InfluenzaA__AHL95892
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagccgguacgugugcuccggccuggugggggacacgccccgcaagaacgacagcuccagcuccagccacugccuggaccccaacaacgaggagggcgggcacggcgucaaggggugggccuucgacgacggcaacgacguguggaugggccggaccaucaacgagaccucccgccucggguacgagaccuucaaggucaucgagggcuggagcaacccgaaguccaagcugcagaucaaccggcaggucaucguggaccgcggggaccggagcggcuacuccgggaucuucagcguggagggcaaguccugcaucaaccgcugcuucuacguggagcugauccggggccgcaaggaggagaccgaggugcucuggaccagcaacagcaucgucguguucugcgggacguccggcaccuacgggaccggcagcuggcccgacggggccgaccugaaccugaugcccaucuga

SEQ ID NO: 85755 - RNA, 1410 nt, Artificial Sequence; identical to SEQ ID NO: 83154
  derived and/or modified sequence opt1 from neuraminidase__InfluenzaA__AHL95904

SEQ ID NO: 85756 - RNA, 1410 nt, Artificial Sequence
  derived and/or modified sequence opt1 from neuraminidase__InfluenzaA__AHL95916
augaaccccaaccagaagaucaucaccaucggcagcgugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccucgggcagggcaccacgcugaacaacgugcacuccaacaacaccguccgcgaccggacccccuaccgcacccugcucaugaacgagcugggcgugcccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggucagcugguccaaggagauccugcgcacccaggagagcgagugcgugugcaucaacgggacgugcaccguggucaugaccgacggcuccgccagcggcaaggccgacaccaagauccucuucaucgaggaggggaagaucgugcacacgagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccucgaccccaacaacgaggagggcgggcacggcgucaaggggugggccuucgacgacggcaacgacguguggaugggccgcaccaucaacgagacgagccggcugggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcucauccgcggccggaaggaggagaccgaggugcuguggaccagcaacuccaucgucguguucugcgggacgagcggcaccuacgggaccggcuccuggcccgacggggccgaccugaaccucaugcccaucuga

SEQ ID NO: 85757 - RNA, 1410 nt, Artificial Sequence; identical to SEQ ID NO: 84891
  derived and/or modified sequence opt1 from neuraminidase__InfluenzaA__AHL95928

SEQ ID NO: 85758 - RNA, 1410 nt, Artificial Sequence; identical to SEQ ID NO: 84879
  derived and/or modified sequence opt1 from neuraminidase__InfluenzaA__AHL95940

SEQ ID NO: 85759 - RNA, 1410 nt, Artificial Sequence; identical to SEQ ID NO: 83154
  derived and/or modified sequence opt1 from neuraminidase__InfluenzaA__AHL95952

SEQ ID NO: 85760 - RNA, 1410 nt, Artificial Sequence; identical to SEQ ID NO: 83154
  derived and/or modified sequence opt1 from neuraminidase__InfluenzaA__AHL95964

SEQ ID NO: 85761 - RNA, 1410 nt, Artificial Sequence; identical to SEQ ID NO: 83154
  derived and/or modified sequence opt1 from neuraminidase__InfluenzaA__AHL95976

SEQ ID NO: 85762 - RNA, 1410 nt, Artificial Sequence; identical to SEQ ID NO: 83154
  derived and/or modified sequence opt1 from neuraminidase__InfluenzaA__AHL95988

SEQ ID NO: 85763 - RNA, 1410 nt, Artificial Sequence; identical to SEQ ID NO: 83154
  derived and/or modified sequence opt1 from neuraminidase__InfluenzaA__AHL96000

SEQ ID NO: 85764 - RNA, 1410 nt, Artificial Sequence
  derived and/or modified sequence opt1 from neuraminidase__InfluenzaA__AHL96012
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggugcccuacgugagcugcgacccggacaagugcuaccaguucgcccuggggcagggcaccacgcucaacaacguccacuccaacaacaccgugcgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccgucgugagcugguccaaggagauccugcgcacccaggagagcgagugcgugugcaucaacgggacgugcaccgucgugaugaccgacggcuccgccagcggcaaggccgacaccaagauccuguucaucgaggaggggaagaucgugcacacgagcacccucuccggcagcgcgcagcacgucgaggagugcuccugcuacccccgguacccgggggugcgcugcgugugccgggacaacuggaagggcagcaaccgccccaucgucgacaucaacaucaaggaccacuccaucgugagcuccuacgugugcagcggccuggucggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggugaucgucgaccgcggggaccgguccggcuacagcgggaucuucuccguggagggcaagagcugcaucaaccggugcuucuacguggagcugauccgcggccggaaggaggagaccgagguccucuggaccagcaacuccaucgugguguucugcgggacgagcggcaccuacgggaccggcuccuggcccgacggggccgaccugaaccugaugcccaucuga

SEQ ID NO: 85765 - RNA, 1410 nt, Artificial Sequence
  derived and/or modified sequence opt1 from neuraminidase__InfluenzaA__AHL96024
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagaaccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85766 - RNA, 1410 nt, Artificial Sequence; identical to SEQ ID NO: 83154
  derived and/or modified sequence opt1 from neuraminidase__InfluenzaA__AHL96036

SEQ ID NO: 85767 - RNA, 1410 nt, Artificial Sequence; identical to SEQ ID NO: 84397
  derived and/or modified sequence opt1 from neuraminidase__InfluenzaA__AHL96048

SEQ ID NO: 85768 - RNA, 1410 nt, Artificial Sequence; identical to SEQ ID NO: 83154
  derived and/or modified sequence opt1 from neuraminidase__InfluenzaA__AHL96059

SEQ ID NO: 85769 - RNA, 1410 nt, Artificial Sequence; identical to SEQ ID NO: 84891
  derived and/or modified sequence opt1 from neuraminidase__InfluenzaA__AHL96071

SEQ ID NO: 85770 - RNA, 1410 nt, Artificial Sequence; identical to SEQ ID NO: 85732
  derived and/or modified sequence opt1 from neuraminidase__InfluenzaA__AHL96083

SEQ ID NO: 85771 - RNA, 1410 nt, Artificial Sequence; identical to SEQ ID NO: 83154
  derived and/or modified sequence opt1 from neuraminidase__InfluenzaA__AHL96095

SEQ ID NO: 85772 - RNA, 1410 nt, Artificial Sequence
  derived and/or modified sequence opt1 from neuraminidase__InfluenzaA__AHL96107
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacacgccccggaagaacgacaacuccagcuccagccacugccuggaccccaacaacgaggagggcgggcacggcgugaaggggugggccuucgacgacggcaacgacgucuggaugggccgcaccaucaacgagaccucccggcucggguacgagaccuucaaggugaucgagggcuggagcaacccgaaguccaagcugcagaucaaccgccaggucaucguggaccgcggggaccggagcggcuacuccgggaucuucagcguggagggcaaguccugcaucaaccggugcuucuacgucgagcugauccgcggccggaaggaggagaccgaggugcucuggaccagcaacagcaucguggucuucugcgggacguccggcaccuacgggaccggcagcuggcccgacggggccgaccugaaccugaugcccaucuga

SEQ ID NO: 85773 - RNA, 1410 nt, Artificial Sequence; identical to SEQ ID NO: 83154
  derived and/or modified sequence opt1 from neuraminidase__InfluenzaA__AHL96119

SEQ ID NO: 85774 - RNA, 1410 nt, Artificial Sequence; identical to SEQ ID NO: 84891
  derived and/or modified sequence opt1 from neuraminidase__InfluenzaA__AHL96131

SEQ ID NO: 85775 - RNA, 1410 nt, Artificial Sequence; identical to SEQ ID NO: 83154
  derived and/or modified sequence opt1 from neuraminidase__InfluenzaA__AHL96143

SEQ ID NO: 85776 - RNA, 1410 nt, Artificial Sequence; identical to SEQ ID NO: 83154
  derived and/or modified sequence opt1 from neuraminidase__InfluenzaA__AHL96167

SEQ ID NO: 85777 - RNA, 1410 nt, Artificial Sequence; identical to SEQ ID NO: 83154
  derived and/or modified sequence opt1 from neuraminidase__InfluenzaA__AHL96179

SEQ ID NO: 85778 - RNA, 1410 nt, Artificial Sequence
  derived and/or modified sequence opt1 from neuraminidase__InfluenzaA__AHL96191
augaaccccaaccagaagaucaucaccaucggcagcgugucccugaccaucagcacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacaugcacuccaacaacaccgugcgcgaccggacccccuaccgcacccugcugaugaacgagcucggcguccccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggugagcugguccaaggagauccugcgcacccaggagagcgagugcgucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgccccaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcugauccgcggccggaaggaggagaccgaggugcucuggaccagcaacuccaucguggucuucugcgggacgagcggcaccuacgggaccggcuccuggcccgacggggccgaccugaaccugaugcccaucuga

SEQ ID NO: 85779 - RNA, 1410 nt, Artificial Sequence; identical to SEQ ID NO: 84879
  derived and/or modified sequence opt1 from neuraminidase__InfluenzaA__AHL96203

SEQ ID NO: 85780 - RNA, 1410 nt, Artificial Sequence; identical to SEQ ID NO: 84891
  derived and/or modified sequence opt1 from neuraminidase__InfluenzaA__AHL96215

SEQ ID NO: 85781 - RNA, 1410 nt, Artificial Sequence; identical to SEQ ID NO: 83154
  derived and/or modified sequence opt1 from neuraminidase__InfluenzaA__AHL96227

SEQ ID NO: 85782 - RNA, 1410 nt, Artificial Sequence; identical to SEQ ID NO: 83154
  derived and/or modified sequence opt1 from neuraminidase__InfluenzaA__AHL96239

SEQ ID NO: 85783 - RNA, 1410 nt, Artificial Sequence; identical to SEQ ID NO: 83154
  derived and/or modified sequence opt1 from neuraminidase__InfluenzaA__AHL96251

SEQ ID NO: 85784 - RNA, 1410 nt, Artificial Sequence; identical to SEQ ID NO: 83154
  derived and/or modified sequence opt1 from neuraminidase__InfluenzaA__AHL96263

SEQ ID NO: 85785 - RNA, 1410 nt, Artificial Sequence; identical to SEQ ID NO: 84935
  derived and/or modified sequence opt1 from neuraminidase__InfluenzaA__AHL96277

SEQ ID NO: 85786 - RNA, 1410 nt, Artificial Sequence
  derived and/or modified sequence opt1 from neuraminidase__InfluenzaA__AHL96308
augaaccccaaccagaagaucaucaccaucggcagcgugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucagcaaggacaacuccauccgccugagcgccgggggcgacaucugggucacccgggagcccuacguguccugcgacccggacaagugcuaccaguucgcccuggggcagggcaccacgcucaacaacgugcacagcaacaacaccguccgcgaccggacccccuaccgcacccugcugauguccgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagggcaagagcugcaucaaccggugcuucuacguggagcugauccgcggccggaaggaggagaccgaggugcucuggaccagcaacuccaucgucguguucugcgggacgagcggcaccuacgggaccggcuccuggcccgacggggccgaccugaaccugaugcccaucuga

SEQ ID NO: 85787 - RNA, 1410 nt, Artificial Sequence; identical to SEQ ID NO: 84383
  derived and/or modified sequence opt1 from neuraminidase__InfluenzaA__AHL96321

SEQ ID NO: 85788 - RNA, 1410 nt, Artificial Sequence; identical to SEQ ID NO: 83154
  derived and/or modified sequence opt1 from neuraminidase__InfluenzaA__AHL96333

SEQ ID NO: 85789 - RNA, 1410 nt, Artificial Sequence
  derived and/or modified sequence opt1 from neuraminidase__InfluenzaA__AHL96345
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacacgccccggaagaacgacaacuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85790 - RNA, 1410 nt, Artificial Sequence; identical to SEQ ID NO: 84879
  derived and/or modified sequence opt1 from neuraminidase__InfluenzaA__AHL96357

SEQ ID NO: 85791 - RNA, 1410 nt, Artificial Sequence; identical to SEQ ID NO: 83154
  derived and/or modified sequence opt1 from neuraminidase__InfluenzaA__AHL96369

SEQ ID NO: 85792 - RNA, 1410 nt, Artificial Sequence; identical to SEQ ID NO: 83154
  derived and/or modified sequence opt1 from neuraminidase__InfluenzaA__AHL96381

SEQ ID NO: 85793 - RNA, 1410 nt, Artificial Sequence; identical to SEQ ID NO: 84891
  derived and/or modified sequence opt1 from neuraminidase__InfluenzaA__AHL96393

SEQ ID NO: 85794 - RNA, 1410 nt, Artificial Sequence
  derived and/or modified sequence opt1 from neuraminidase__InfluenzaA__AHL96405
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccugggccccaacaacgaggagggcgggcacggggucaagggcugggccuucgacgacggcaacgacguguggauggggcgcaccaucaacgagacgagccggcucggcuacgagaccuucaaggucaucgaggggugguccaaccccaagagcaagcugcagaucaaccgccaggugaucguggaccggggcgaccgcuccggguacagcggcaucuucuccgucgagggcaagagcugcaucaaccggugcuucuacguggagcugauccgcgggcggaaggaggagaccgaggugcucuggaccagcaacuccaucgucguguucugcggcacgagcgggaccuacggcaccggguccuggcccgacggcgccgaccugaaccugaugcccaucuga

SEQ ID NO: 85795 - RNA, 1410 nt, Artificial Sequence; identical to SEQ ID NO: 83154
  derived and/or modified sequence opt1 from neuraminidase__InfluenzaA__AHL96417

SEQ ID NO: 85796 - RNA, 1410 nt, Artificial Sequence; identical to SEQ ID NO: 83154
  derived and/or modified sequence opt1 from neuraminidase__InfluenzaA__AHL96429

SEQ ID NO: 85797 - RNA, 1410 nt, Artificial Sequence
  derived and/or modified sequence opt1 from neuraminidase__InfluenzaA__AHL96441
augaaccccaaccagaagaucaucaccaucggcagcgugucccugaccaucagcacgaucugcuucuucaugcagaucgccauccucaucaccaccgucacccugcacuucaagcacuacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgacaucaccggguucgcgcccuucuccaaggacaacagcauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggagcuccagcuccugccacgacgggaaggccuggcugcacgugugcaucaccggcgacgacaagaacgcgaccgccagcuucaucuacaacgggcggcucguggacuccguggucagcugguccaaggagauccugcgcacccaggagagcgagugcgugugcaucaacggcacgugcaccguggucaugaccgacggguccgccagcggcaaggccgacaccaagauccuguucaucgaggagggcaagaucgugcacacgagcacccucuccgggagcgcgcagcacguggaggagugcuccugcuacccccgguacccgggcguccgcugcgugugccgggacaacuggaaggggagcaaccgccccaucguggacaucaacaucaaggaccacuccaucgucagccgguacgugugcuccggccuggugggcgacacgccccgcaagaacgacagcuccagcuccagccacugccugaaccccaacaacgaggagggcgggcacggggucaagggcugggccuucgacgacgggaacgacguguggaugggccggaccaucaacgagaccucccgccucggcuacgagaccuucaaggucaucgagggguggagcaacccgaaguccaagcugcagaucaaccggcagaucaucguggaccgcggcgaccggagcggguacuccggcaucuucagcguggaggggaaguccugcaucaaccgcugcuucuacgucgagcugauccggggccgcaaggaggagaccgaggugcucuggaccagcaacagcaucguggucuucugcggcacguccgggaccuacggcaccgggagcuggcccgacggcgccgaccugaaccugaugcccaucuga

SEQ ID NO: 85798 - RNA, 1410 nt, Artificial Sequence; identical to SEQ ID NO: 83154
  derived and/or modified sequence opt1 from neuraminidase__InfluenzaA__AHL96453

SEQ ID NO: 85799 - RNA, 1410 nt, Artificial Sequence; identical to SEQ ID NO: 83154
  derived and/or modified sequence opt1 from neuraminidase__InfluenzaA__AHL96465

SEQ ID NO: 85800 - RNA, 1410 nt, Artificial Sequence
  derived and/or modified sequence opt1 from neuraminidase__InfluenzaA__AHL96477
augaaccccaaccagaagaucaucaccaucggcagcgugugcaugaccaucgggauggccaaccugauccuccagaucggcaacaucaucuccaucuggaucagccacuccauccaggucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccagccugugcccgguguccggcugggccaucuacagcaaggacaacuccgugcgcaucggcagcaagggggacgucuucgugauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcugaccaucggcaucagcggccccgacuccggggccguggccgugcucaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccuggaguaccagaucggguacaucugcuccggcaucuucggggacaacccgcggcccaacgacaagaccggcagcugcggccccguguccagcaacggggccaacggcgucaagggguucagcuucaaguacggcaacgggguguggaucggccgcaccaaguccaucagcucccggaagggcuucgagaugaucugggaccccaacggguggaccggcaccgacaacaacuucagcaucaagcaggacaucguggggaucaacgagugguccggcuacagcggguccuucguccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 85801 - RNA, 1410 nt, Artificial Sequence; identical to SEQ ID NO: 84891
  derived and/or modified sequence opt1 from neuraminidase__InfluenzaA__AHL96488

SEQ ID NO: 85802 - RNA, 1410 nt, Artificial Sequence; identical to SEQ ID NO: 83154
  derived and/or modified sequence opt1 from neuraminidase__InfluenzaA__AHL96500

SEQ ID NO: 85803 - RNA, 1410 nt, Artificial Sequence; identical to SEQ ID NO: 83154
  derived and/or modified sequence opt1 from neuraminidase__InfluenzaA__AHL96512

SEQ ID NO: 85804 - RNA, 1410 nt, Artificial Sequence; identical to SEQ ID NO: 84383
  derived and/or modified sequence opt1 from neuraminidase__InfluenzaA__AHL96524

SEQ ID NO: 85805 - RNA, 1410 nt, Artificial Sequence
  derived and/or modified sequence opt1 from neuraminidase__InfluenzaA__AHL96536
augaaccccaaccagaagaucaucaccaucggcagcgugucccugaccaucagcacgaucugcuucuucacccagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcacgaccaucaacaacgugcacuccaacaacaccguccgcgaccggacccccuaccgcacgcuccugaugaacgagcugggcgugcccuuccaccucgggaccaagcaggucugcaucgccuggagcuccagcuccugccacgacggcaaggccuggcugcacgugugcaucaccggggacgacaagaacgcgaccgccagcuucaucuacaacggccggcugguggacuccguggucagcugguccaaggagauccuccgcacgcaggagagcgagugcgugugcaucaacgggaccugcaccguggucaugaccgacggcuccgccagcggcaaggccgacacgaagauccuguucaucgaggaggggaagaucgugcacaccagcacccuguccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccucgugggggacaccccgcggaagaacgacuccagcuccagcucccacugccuggaccccaacaacgaggagggcgggcacggcgucaaggggugggccuucgacgacggcaacgacguguggaugggccgcacgaucaacgagaccagccggcugggguacgagaccuucaaggucaucgagggcugguccaaccccaagagcaagcuccagaucaaccgccaggugaucguggaccgcggggaccgguccggcuacagcgggaucuucuccgucgagggcaagagcugcaucaaccggugcuucuacguggagcugauccgcggccggaaggaggagaccgaggugcuguggacgagcaacuccaucgucguguucugcgggaccagcggcaccuacgggaccggcuccuggcccgacggggccgaccucaaccugaugcccaucuga

SEQ ID NO: 85806 - RNA, 1410 nt, Artificial Sequence; identical to SEQ ID NO: 84891
  derived and/or modified sequence opt1 from neuraminidase__InfluenzaA__AHL96548

SEQ ID NO: 85807 - RNA, 1410 nt, Artificial Sequence
  derived and/or modified sequence opt1 from neuraminidase__InfluenzaA__AHL96560
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcaacgccuccggcaaggccgacaccaagauccuguucaucgaggaggggaagaucgugcacacgagcacccucagcggcuccgcgcagcacguggaggagugcagcugcuacccccgguacccggggguccgcugcgugugccgggacaacuggaagggcuccaaccgccccaucguggacaucaacaucaaggaccacagcaucgucuccagcuacgugugcuccggccuggugggggacacgccccggaagaacgacagcuccagcuccagccacugccuggaccccaacaacgaggagggcgggcacggcgucaaggggugggccuucgacgacggcaacgacguguggaugggccgcaccaucaacgagaccucccggcucggguacgagaccuucaaggucaucgagggcuggagcaacccgaaguccaagcugcagaucaaccgccaggugaucguggaccgcggggaccggagcggcuacuccgggaucuucagcgucgagggcaaguccugcaucaaccggugcuucuacguggagcugauccgcggccggaaggaggagaccgaggugcucuggaccagcaacagcaucgucguguucugcgggacguccggcaccuacgggaccggcagcuggcccgacggggccgaccugaaccugaugcccaucuga

SEQ ID NO: 85808 - RNA, 1410 nt, Artificial Sequence; identical to SEQ ID NO: 84365
  derived and/or modified sequence opt1 from neuraminidase__InfluenzaA__AHL96572

SEQ ID NO: 85809 - RNA, 1410 nt, Artificial Sequence; identical to SEQ ID NO: 85800
  derived and/or modified sequence opt1 from neuraminidase__InfluenzaA__AHL96584

SEQ ID NO: 85810 - RNA, 1410 nt, Artificial Sequence
  derived and/or modified sequence opt1 from neuraminidase__InfluenzaA__AHL96595
augaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgugugcaucaccggggacgacaagaacgcgaccgccagcuucaucuacaacggccggcucguggacuccguggucagcugguccaaggagauccugcgcacccaggagagcgagugcgugugcaucaacgggacgugcaccguggucaugaccgacggcuccgccagcggcaaggccgacaccaagauccuguucaucgaggaggggaagaucgugcacacgagcacccucuccggcagcgcgcagcacguggaggagugcuccugcuacccccgguacccggggguccgcugcgugugccgggacaacuggaagggcagcaaccgccccaucguggacaucaacaucaaggaccacuccaucgucagcuccuacgugugcagcggccuggugggggacaccccgcggaagaacgacuccagcuccagcucccacugccuggaccccaacaacgaggagggcgggcacggcgucaaggggugggccuucgacgacggcaacgacguguggaugggccgcaccaucaacgagacgagccggcucggguacgagaccuucaaggucaucgagggcugguccaaccccaagagcaagcugcagaucaaccgccaggugaucguggaccgcggggaccgguccggcuacagcgggaucuucuccgucgagagcaagagcugcaucaaccggugcuucuacguggagcugauccgcggccggaaggaggagaccgaggugcucuggaccuccaacagcaucgucguguucugcggcacguccgggaccuacggcaccgggagcuggcccgacggcgccgaccugaaccugaugcccaucuga

SEQ ID NO: 85811 - RNA, 1410 nt, Artificial Sequence; identical to SEQ ID NO: 83154
  derived and/or modified sequence opt1 from neuraminidase__InfluenzaA__AHL96607

SEQ ID NO: 85812 - RNA, 1410 nt, Artificial Sequence
  derived and/or modified sequence opt1 from neuraminidase__InfluenzaA__AHL96631
augaaccccaaccagaagaucaucaccaucggcagcgugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccaagcccgccgaguaccggaacuggagcaagccgcagugcgggaucaccggcuucgcgcccuucuccaaggacaacagcauccgccuguccgccgggggcgacaucugggucacccgggagcccuacgugagcugcgaccccgacaagugcuaccaguucgcccucgggcagggcaccacgcugaacaacaugcacuccaacaacaccgugcgcgaccggaccccguaccgcacccugcucaugaacgagcugggcguccccuuccaccuggggacgaagcaggucugcaucgccuggagcuccagcuccugccacgacggcaaggccuggcuccacgugugcaucaccggggacgacaagaacgcgaccgccagcuucaucuacaacggccggcugguggacuccguggugagcugguccaaggagauccugcgcacccaggagagcgagugcgucugcaucaacgggacgugcaccguggugaugaccgacggcuccgccagcggcaaggccgacaccaagauccucuucaucgaggaggggaagaucguccacacgagcacccuguccggcagcgcgcagcacguggaggagugcuccugcuacccccgguaccccggggugcgcugcgucugccgggacaacuggaagggcagcaaccgcccgaucguggacaucaacaucaaggaccacuccaucgugagcuccuacgucugcagcggccuggugggggacacgccccggaagaacgacuccagcuccagcucccacugccucgaccccaacaacgaggagggcgggcacggcgugaaggggugggccuucgacgacggcaacgacgucuggaugggccgcaccaucaacgagaccagccggcugggguacgagaccuucaaggugaucgagggcugguccaaccccaagagcaagcugcagaucaaccgccaggucaucguggaccgcggggaccgguccggcuacagcgggaucuucuccguggagggcaagagcugcaucaaccggugcuucuacgucgagcucauccgcggccggaaggaggagaccgaggugcuguggaccagcaacuccaucguggucuucugcgggacgagcggcaccuacgggaccggcuccuggccggacggggccgaccugaaccucaugcccaucuga

SEQ ID NO: 85813 - RNA, 1410 nt, Artificial Sequence; identical to SEQ ID NO: 84891
  derived and/or modified sequence opt1 from neuraminidase__InfluenzaA__AHL96643

SEQ ID NO: 85814 - RNA, 1410 nt, Artificial Sequence; identical to SEQ ID NO: 83154
  derived and/or modified sequence opt1 from neuraminidase__InfluenzaA__AHL96655
